(12) United States Patent
Mitter et al.

(10) Patent No.: US 10,271,554 B2
(45) Date of Patent: Apr. 30, 2019

(54) PLANTS CONTAINING BENEFICIAL ENDOPHYTES

(71) Applicants: INDIGO AG, INC., Boston, MA (US); AIT AUSTRIAN INSTITUTE OF TECHNOLOGY GMBH, Vienna (AT)

(72) Inventors: Birgit Mitter, Giesshübl (AT); Muhammad Naveed, Faisalabad (PK); Teresa Berninger, Vienna (AT); Stephane Compant, Vienna (AT); Angela Sessitsch, Vienna (AT); Geoffrey Von Maltzahn, Boston, CA (US); Richard Bailey Flavell, Thousand Oaks, CA (US); Gerardo V. Toledo, Belmont, MA (US); Slavica Djonovic, Malden, MA (US); Luis Miguel Marquez, Belmont, MA (US); David Morris Johnston, Cambridge, MA (US); Yves Alain Millet, Newtonville, MA (US); Jeffrey Lyford, Hollis, NH (US); Jonathan W. Leff, Cambridge, MA (US); Phillip Samayoa, Cambridge, MA (US); Craig Sadowski, Somerville, MA (US)

(73) Assignee: AIT AUSTRIAN INSTITUTE OF TECHNOLOGY GMBH, Vienna (AT)

( * ) Notice: Subject to any disclaimer, the term of this patent is extended or adjusted under 35 U.S.C. 154(b) by 0 days.

(21) Appl. No.: 15/107,973

(22) PCT Filed: Dec. 24, 2014

(86) PCT No.: PCT/US2014/072399
§ 371 (c)(1),
(2) Date: Jun. 24, 2016

(87) PCT Pub. No.: WO2015/100431
PCT Pub. Date: Jul. 2, 2015

(65) Prior Publication Data
US 2016/0338360 A1   Nov. 24, 2016

Related U.S. Application Data

(60) Provisional application No. 61/920,517, filed on Dec. 24, 2013, provisional application No. 61/920,638, filed on Dec. 24, 2013, provisional application No. 61/920,554, filed on Dec. 24, 2013, provisional application No. 61/920,616, filed on Dec. 24, 2013, provisional application No. 61/920,659, filed on Dec. 24, 2013, provisional application No. 61/920,529, filed on Dec. 24, 2013, provisional application No. 61/920,557, filed on Dec. 24, 2013.

(51) Int. Cl.
| | | |
|---|---|---|
| C12N 1/20 | (2006.01) | |
| A01N 25/00 | (2006.01) | |
| A01N 63/00 | (2006.01) | |
| A01N 63/02 | (2006.01) | |
| G01N 33/00 | (2006.01) | |

(52) U.S. Cl.
CPC ............ *A01N 63/02* (2013.01); *A01N 63/00* (2013.01); *C12N 1/20* (2013.01); *G01N 33/0098* (2013.01)

(58) Field of Classification Search
CPC ................................ A01N 63/00; A01N 63/02
See application file for complete search history.

(56) References Cited

U.S. PATENT DOCUMENTS

| | | | |
|---|---|---|---|
| 2,200,532 | A | 5/1940 | Sherman |
| 4,940,834 | A | 7/1990 | Hurley et al. |
| 5,041,290 | A | 8/1991 | Gindrat et al. |
| 5,113,619 | A | 5/1992 | Leps et al. |
| 5,229,291 | A | 7/1993 | Nielsen et al. |
| 5,292,507 | A | 3/1994 | Charley |
| 5,415,672 | A | 5/1995 | Fahey et al. |
| 5,730,973 | A | 3/1998 | Morales et al. |
| 5,919,447 | A | 7/1999 | Marrone et al. |
| 5,994,117 | A | 11/1999 | Bacon et al. |
| 6,072,107 | A | 6/2000 | Latch et al. |
| 6,077,505 | A | 6/2000 | Parke et al. |
| 6,337,431 | B1 | 1/2002 | Tricoli et al. |
| 6,495,133 | B1 | 12/2002 | Xue |
| 6,681,186 | B1 | 1/2004 | Denisov et al. |
| 6,689,880 | B2 | 2/2004 | Chen et al. |
| 6,823,623 | B2 | 11/2004 | Minato et al. |

(Continued)

FOREIGN PATENT DOCUMENTS

| | | |
|---|---|---|
| CA | 1041788 | 11/1978 |
| CA | 1229497 | 11/1987 |

(Continued)

OTHER PUBLICATIONS

Compant et al., "Endophytes of Grapevine Flowerrs, Berries, and Seeds: Identification of Cultivable Bacteria, Comparison with other Plant Parts, and Visualization of Niches of Colonization", Microb Ecol 62: 188-197 (2011).*

(Continued)

*Primary Examiner* — Lee A Visone
(74) *Attorney, Agent, or Firm* — Fenwick & West LLP

(57) ABSTRACT

This application relates to methods and materials for providing a benefit to a seed, seedling or plant by producing seeds that are internally colonized with endophytes. Beneficial endophytes with particular characteristics are provided. These may be used in the methods described to provide a benefit to a seed, seedling or plant.

12 Claims, 38 Drawing Sheets
Specification includes a Sequence Listing.

(56) References Cited

U.S. PATENT DOCUMENTS

| | | | |
|---|---|---|---|
| 7,037,879 B2 | 5/2006 | Imada et al. |
| 7,084,331 B2 | 8/2006 | Isawa et al. |
| 7,335,816 B2 | 2/2008 | Kraus et al. |
| 7,341,868 B2 | 3/2008 | Chopade et al. |
| 7,485,451 B2 | 2/2009 | VanderGheynst et al. |
| 7,555,990 B2 | 7/2009 | Beaujot |
| 7,632,985 B2 | 12/2009 | Malven et al. |
| 7,763,420 B2 | 7/2010 | Stritzker et al. |
| 7,906,313 B2 | 3/2011 | Henson et al. |
| 7,977,550 B2 | 7/2011 | West et al. |
| 8,143,045 B2 | 3/2012 | Miansnikov et al. |
| 8,455,198 B2 | 6/2013 | Gao et al. |
| 8,455,395 B2 | 6/2013 | Miller et al. |
| 8,465,963 B2 | 6/2013 | Rolston et al. |
| 8,728,459 B2 | 5/2014 | Isawa et al. |
| 8,975,489 B2 | 3/2015 | Craven |
| 9,113,636 B2 | 8/2015 | von Maltzahn et al. |
| 9,277,751 B2 | 3/2016 | Sword |
| 9,288,995 B2 | 3/2016 | von Maltzahn et al. |
| 9,295,263 B2 | 3/2016 | von Maltzahn et al. |
| 9,364,005 B2 | 6/2016 | Miller et al. |
| 9,408,394 B2 | 8/2016 | von Maltzahn et al. |
| 9,532,572 B2 | 1/2017 | von Maltzahn et al. |
| 9,532,573 B2 | 1/2017 | von Maltzahn et al. |
| 9,545,111 B2 | 1/2017 | Sword |
| 9,622,485 B2 * | 4/2017 | von Maltzahn | A01N 63/02 |
| 9,687,001 B2 | 6/2017 | Vujanovic et al. |
| 9,756,865 B2 | 9/2017 | Sword |
| 10,058,101 B2 | 8/2018 | von Maltzahn et al. |
| 10,076,120 B2 | 9/2018 | von Maltzahn et al. |
| 2005/0072047 A1 | 4/2005 | Conkling et al. |
| 2006/0046246 A1 | 3/2006 | Zeng et al. |
| 2007/0028318 A1 | 2/2007 | Livore et al. |
| 2007/0055456 A1 | 3/2007 | Raftery et al. |
| 2007/0142226 A1 | 6/2007 | Franco |
| 2007/0292953 A1 | 12/2007 | Mankin et al. |
| 2008/0229441 A1 | 9/2008 | Young et al. |
| 2008/0289060 A1 | 11/2008 | De Beuckeleer et al. |
| 2009/0155214 A1 | 6/2009 | Isawa et al. |
| 2010/0064392 A1 | 3/2010 | Yang et al. |
| 2010/0095396 A1 | 4/2010 | Voeste et al. |
| 2010/0205690 A1 | 8/2010 | Blasing et al. |
| 2010/0227357 A1 | 9/2010 | Redman et al. |
| 2011/0182862 A1 | 7/2011 | Green et al. |
| 2012/0108431 A1 | 5/2012 | Williams et al. |
| 2012/0131696 A1 | 5/2012 | Aayal et al. |
| 2012/0144533 A1 | 6/2012 | Craven |
| 2012/0149571 A1 | 6/2012 | Kloepper et al. |
| 2012/0178624 A1 | 7/2012 | Kaminskyj et al. |
| 2012/0324599 A1 | 12/2012 | Kerns et al. |
| 2013/0031673 A1 | 1/2013 | Grandlic et al. |
| 2013/0071425 A1 | 3/2013 | Vidal et al. |
| 2013/0079225 A1 | 3/2013 | Smith et al. |
| 2013/0150240 A1 * | 6/2013 | Newman | A01N 63/00 504/117 |
| 2013/0233501 A1 | 9/2013 | Van Zyl et al. |
| 2014/0020136 A1 | 1/2014 | Van Der Wolf et al. |
| 2014/0109249 A1 | 4/2014 | Turner et al. |
| 2014/0115731 A1 | 4/2014 | Turner et al. |
| 2014/0147425 A1 | 5/2014 | Henn et al. |
| 2014/0342905 A1 * | 11/2014 | Bullis | A01N 63/00 504/100 |
| 2015/0020239 A1 * | 1/2015 | von Maltzahn | A01N 63/02 800/298 |
| 2015/0033420 A1 | 1/2015 | Rodriguez et al. |
| 2015/0126365 A1 | 5/2015 | Sword |
| 2015/0230478 A1 | 8/2015 | Vujanovic et al. |
| 2015/0335029 A1 | 11/2015 | Mitter et al. |
| 2015/0366217 A1 | 12/2015 | Vujanovic et al. |
| 2015/0368607 A1 | 12/2015 | Arnold et al. |
| 2015/0373993 A1 | 12/2015 | von Maltzahn et al. |
| 2016/0150796 A1 | 6/2016 | von Maltzahn et al. |
| 2016/0174570 A1 | 6/2016 | Vujanovic et al. |
| 2016/0192662 A1 | 7/2016 | Sword |
| 2016/0205947 A1 | 7/2016 | Sword |
| 2016/0235074 A1 | 8/2016 | von Maltzahn et al. |
| 2016/0255844 A1 | 9/2016 | Mitter et al. |
| 2016/0286821 A1 | 10/2016 | Sword |
| 2016/0316760 A1 | 11/2016 | Ambrose et al. |
| 2016/0316763 A1 | 11/2016 | Sword |
| 2016/0330976 A1 | 11/2016 | Mitter et al. |
| 2016/0366892 A1 | 12/2016 | Ambrose et al. |
| 2017/0020138 A1 | 1/2017 | von Maltzahn et al. |
| 2017/0164619 A1 | 6/2017 | von Maltzahn et al. |
| 2017/0164620 A1 | 6/2017 | von Maltzahn et al. |
| 2017/0215358 A1 | 8/2017 | Franco et al. |
| 2017/0223967 A1 | 8/2017 | Mitter et al. |
| 2018/0020677 A1 | 1/2018 | Ambrose et al. |
| 2018/0092365 A1 | 4/2018 | Sword |
| 2018/0153174 A1 | 6/2018 | Riley et al. |
| 2018/0177196 A1 | 6/2018 | Sword |
| 2018/0213800 A1 | 8/2018 | Djonovic et al. |
| 2018/0249716 A1 | 9/2018 | Raymond |
| 2018/0251776 A1 | 9/2018 | Raymond |

FOREIGN PATENT DOCUMENTS

| | | | |
|---|---|---|---|
| CA | 2562175 | 1/2013 |
| CN | 1604732 | 4/2005 |
| CN | 101311262 A | 11/2008 |
| CN | 101423810 A | 5/2009 |
| CN | 101570738 | 11/2009 |
| CN | 101693881 A | 4/2010 |
| CN | 102168022 A | 8/2011 |
| CN | 102352327 A | 2/2012 |
| CN | 102010835 B | 4/2012 |
| CN | 102533601 B | 10/2013 |
| CN | 103642725 A | 3/2014 |
| CN | 104388356 A | 3/2015 |
| EP | 0192342 | 8/1986 |
| EP | 0223662 | 5/1987 |
| EP | 0378000 | 7/1990 |
| EP | 0494802 | 7/1992 |
| EP | 0818135 | 1/1998 |
| EP | 1621632 A1 | 2/2006 |
| EP | 1935245 | 6/2008 |
| EP | 2676536 | 12/2013 |
| JP | 2009/072168 | 4/2009 |
| KR | 20100114806 A | 10/2010 |
| KR | 101091151 | 12/2011 |
| KR | 20130023491 | 3/2013 |
| WO | WO 1988/009114 | 1/1988 |
| WO | WO 1994/016076 | 7/1994 |
| WO | WO 2000/029607 | 5/2000 |
| WO | WO 2001/083818 | 11/2001 |
| WO | WO 2002/065836 | 8/2002 |
| WO | WO 2005/003328 | 1/2005 |
| WO | WO 2007/021200 | 2/2007 |
| WO | WO 2007/107000 | 9/2007 |
| WO | WO 2008/103422 | 8/2008 |
| WO | WO 2009/012480 A2 | 1/2009 |
| WO | WO 2009/078710 A1 | 6/2009 |
| WO | WO 2009/126473 A1 | 10/2009 |
| WO | WO 2010/109436 | 9/2010 |
| WO | WO 2010/115156 | 10/2010 |
| WO | WO 2011/001127 | 1/2011 |
| WO | WO 2011/082455 | 7/2011 |
| WO | WO 2011/112781 | 9/2011 |
| WO | WO 2011/117351 | 9/2011 |
| WO | WO-2011112781 A2 * | 9/2011 | ............ A01N 63/00 |
| WO | WO 2012/034996 | 3/2012 |
| WO | WO 2013/016361 | 1/2013 |
| WO | WO 2013/029112 | 3/2013 |
| WO | WO 2013090628 A1 * | 6/2013 | ............ A01N 63/00 |
| WO | WO-2013090628 A1 * | 6/2013 | ............ A01N 63/00 |
| WO | WO 2013/122473 | 8/2013 |
| WO | WO 2013/177615 | 12/2013 |
| WO | WO 2013/190082 | 12/2013 |
| WO | WO 2014/046553 | 3/2014 |
| WO | WO 2014/082950 | 6/2014 |
| WO | WO 2014/121366 | 8/2014 |
| WO | WO 2014/206953 | 12/2014 |
| WO | WO 2014/210372 | 12/2014 |
| WO | WO 2015/035099 | 3/2015 |

(56) References Cited

FOREIGN PATENT DOCUMENTS

| | | |
|---|---|---|
| WO | WO 2015/069938 | 5/2015 |
| WO | WO 2015/100431 | 7/2015 |
| WO | WO 2015/100432 | 7/2015 |
| WO | WO 2015/200852 | 12/2015 |
| WO | WO 2015/200902 | 12/2015 |
| WO | WO 2016/109758 | 7/2016 |
| WO | WO 2016/179046 | 11/2016 |
| WO | WO 2016/179047 | 11/2016 |
| WO | WO 2016/200987 | 12/2016 |

OTHER PUBLICATIONS

Darsonval et al., "Adhesion and fitness in the bean phyllosphere and transmission to seed of *Xanthomonas fuscans* subsp. *fuscans*", Molecular Plant-Microbe Interactions 22: 747-757 (2009).*
Seed Starting.*
Darsonval et al., "The type III secretion system of *Xanthomonas fuscans* subsp. *fuscans* is involved in the phyllosphere colonization process and in transmission to seeds of susceptible beans", App Environmental Microbiol 74: 2669-2678 (2008).*
Büttner et al., "Regulation and secretion of Xanthomonas virulence factors", FEMS Microbiol Rev 34: 107-133 (2010).*
Darsonval et al., "Adhesion and fitness in the bean phyllosphere and transmission to seed of *Xanthomonas fuscans* subsp. *fuscans*", Molecular Plant-Microbe Interactions 22: 747-757 (2009) (Year: 2009).*
Compant et al., "Endophytes of Grapevine Flowers, Berries, and Seeds: Identification of Cultivable Bacteria, Comparison with other Plant Parts, and Visualization of Niches of Colonization", Microb Ecol 62: 188-197 (2011) (Year: 2011).*
Yennamalli et al., "Endoglucanases: insights into thermostability for biofuel applications", Biotech Biofuels 6: 136 (2013) (Year: 2013).*
Kim et al., "Towards a taxonomic coherence between average nucleotide identity and 16S rRNA gene sequence similarity for species demarcation of prokaryotes", Int J Systematic Evolutionary Microbiol 64: 346-351 (2014) (Year: 2014).*
Sarkar et al (Canadian Journal of Microbiology, 2015, vol. 61, No. 7 : pp. 477-486) (Year: 2015).*
Enterobacteriaceae bacterium Clero1 16S ribosomal RNA gene, partial sequence. GenBank: JX880250.1 (Year: 2015).*
PCT Invitation to Pay Additional Fees, PCT Application No. PCT/CA2013/000091, Mar. 27, 2013, 2 Pages.
PCT International Search Report and Written Opinion for PCT/CA2013/000091, dated Sep. 20, 2013, 17 Pages.
PCT International Search Report and Written Opinion for PCT/EP2013/062976, dated Dec. 22, 2014, 9 Pages.
PCT International Search Report, Application No. PCT/US2014/044427, dated Dec. 3, 2014, 9 Pages.
PCT International Search Report and Written Opinion, Application No. PCT/US2014/054160, dated Dec. 9, 2014, 21 Pages.
PCT Invitation to Pay Additional Fees, PCT Application No. PCT/US2014/064411, Feb. 5, 2015, 2 Pages.
PCT International Search Report and Written Opinion, International Application No. PCT/US2014/064411, dated Mar. 27, 2015, 15 Pages.
PCT Invitation to Pay Additional Fees, PCT Application No. PCT/US2014/072399, Apr. 14, 2015, 2 Pages.
PCT International Search Report and Written Opinion, International Application No. PCT/US2014/072399, dated Jun. 26, 2015, 22 Pages.
PCT Invitation to Pay Additional Fees, PCT Application No. PCT/US2014/072400, Apr. 16, 2015, 6 Pages.
PCT International Search Report and Written Opinion, Application No. PCT/US2014/072400, dated Jul. 8, 2015, 38 Pages.
PCT International Search Report and Written Opinion, Application No. PCT/AU2014/000360, dated Aug. 5, 2015, 12 Pages.
PCT Invitation to Pay Additional Fees, PCT Application No. PCT/US2015/038110, Sep. 22, 2015, 8 Pages.
PCT Invitation to Pay Additional Fees, PCT Application No. PCT/US2015/038187, Oct. 14, 2015, 5 Pages.
PCT International Search Report and Written Opinion, PCT Application No. PCT/US2015/038110, dated Dec. 11, 2015, 36 Pages.
PCT International Search Report and Written Opinion, PCT Application No. PCT/US2015/038187, dated Jan. 22, 2016, 36 Pages.
PCT Invitation to Pay Additional Fees, PCT Application No. PCT/US2015/068206, Apr. 12, 2016, 5 Pages.
PCT International Search Report and Written Opinion, PCT Application No. PCT/US2015/068206, dated Jun. 27, 2016, 20 Pages.
PCT International Search Report and Written Opinion, PCT Application No. PCT/US2016/030292, dated Aug. 12, 2016, 20 Pages.
PCT International Preliminary Report on Patentability, PCT Application No. PCT/US2016/030292, dated Aug. 2, 2017, 23 Pages.
PCT International Search Report and Written Opinion, PCT Application No. PCT/US2016/030293, dated Aug. 11, 2016, 23 Pages.
PCT International Search Report and Written Opinion, PCT Application No. PCT/US2016/036504, dated Nov. 4, 2016, 18 Pages.
PCT International Search Report and Written Opinion, PCT Application No. PCT/US2016/039191, dated Nov. 29, 2016, 20 Pages.
PCT International Search Report and Written Opinion, PCT Application No. PCT/US2016/068144, dated May 18, 2017, 30 Pages.
Canadian Patent Office, Office Action, Canadian Patent Application No. 2,916,678, dated Feb. 8, 2017, 8 Pages.
Canadian Patent Office, Office Action, Canadian Patent Application No. 2,935,218, dated Jun. 13, 2017, 5 Pages.
Chinese Patent Office, Office Action, Chinese Patent Application No. 201480072142.7, dated Apr. 25, 2017, 14 Pages (with English translation).
European Patent Office, Supplementary Partial European Search Report, European Patent Application No. 13874703.5, dated Jun. 21, 2016, 3 Pages.
European Patent Office, Supplementary European Search Report, European Patent Application No. 13874703.5, dated Oct. 21, 2016, 16 Pages.
European Patent Office, Supplementary European Search Report, European Patent Application No. 14860187.5, dated May 24, 2017, 9 Pages.
European Patent Office, Supplementary European Search Report, European Patent Application No. 14874589.6, dated Jul. 11, 2017, 9 Pages.
European Patent Office, Examination Report, European Patent Application No. 14748326.7, dated Jul. 19, 2017, 4 Pages.
Intellectual Property Australia, Examination Report for Australian Patent Application No. 2016202480, dated Apr. 28, 2016, 2 Pages.
Intellectual Property Australia, Examination Report for Australian Patent Application No. 2014346664, dated Nov. 24, 2016, 3 Pages.
Intellectual Property Australia, Examination Report for Australian Patent Application No. 2014315191, dated Jul. 15, 2017, 6 Pages.
Intellectual Property Australia, Examination Report for Australian Patent Application No. 2015279600, dated Jul. 21, 2017, 7 Pages.
Intellectual Property Australia, Examination Report for Australian Patent Application No. 2015278238, dated Jul. 24, 2017, 3 Pages.
New Zealand Intellectual Property Office, First Examination Report, New Zealand Patent Application No. 715728, dated May 10, 2016, 4 Pages.
New Zealand Intellectual Property Office, First Examination Report, New Zealand Patent Application No. 715728, dated Dec. 5, 2016, 3 Pages.
New Zealand Intellectual Property Office, First Examination Report, New Zealand Patent Application No. 727449, dated Jun. 8, 2017, 7 Pages.
New Zealand Intellectual Property Office, First Examination Report, New Zealand Patent Application No. 726116, dated Jun. 29, 2017, 2 Pages.
New Zealand Intellectual Property Office, Second Examination Report, New Zealand Patent Application No. 726116, dated Sep. 26, 2017, 5 Pages.
New Zealand Intellectual Property Office, First Examination Report, New Zealand Patent Application No. 728495, dated Jul. 12, 2017, 5 Pages.

(56) References Cited

OTHER PUBLICATIONS

Russian Patent Office, Office Action for Russian Patent Application No. 2015137613, dated Jun. 7, 2017, 14 Pages (with English translation).

Ukraine Patent Office, Office Action for Ukrainian Patent Application No. a201508515, dated May 19, 2017, 14 Pages (with English translation).

Abarenkov, K., et al., "PlutoF—A Web Based Workbench for Ecological and Taxonomic Research, with an Online Implementation for Fungal ITS Sequences," Evol Bioinform Online, 2010, pp. 189-196, vol. 6.

Abarenkov, K., et al., "The Unite Database for Molecular Identification of Fungi—Recent Updates and Future Perspectives," New Phytol., 2010, pp. 281-285, vol. 186.

Abdellatif, L., et al., "Endophytic hyphal compartmentalization is required for successful symbiotic Ascomycota association with root cells," Mycological Research, 2009, pp. 782-791, vol. 113.

Ahmad, F., et al., "Screening of Free-Living Rhizospheric Bacteria for Their Multiple Plant Growth Promoting Activities," Microbiol Res., 2008, pp. 173-181, vol. 163.

Amann, R., et al., "The Identification of Microorganisms by Fluorescence in Situ Hybridisation," Curr Opin Biotechnol., 2001, pp. 231-236, vol. 12.

Apel, K., et al., "Reactive Oxygen Species: Metabolism, Oxidative Stress, and Signal Transduction," Annu Rev Plant Biol., 2004, pp. 373-399, vol. 55.

Arendt, K. R., et al., "Isolation of endohyphal bacteria from foliar Ascomycota and in vitro establishment of their symbiotic associations," Appl. Environ. Microbiol., 2016, pp. 2943-2949, vol. 82, No. 10.

Ashrafuzzaman, M., et al., "Efficiency of plant growth-promoting rhizobacteria (PGPR) for the enhancement of rice growth," African Journal of Biotechnology, 2009, pp. 1247-1252, vol. 8, No. 7.

Bacon, C. W., et al., "Isolation, In Planta Detection, and Uses of Endophytic Bacteria for Plant Protection," Manual of Environmental Microbiology, 2007, pp. 638-647.

Baker, K. F., et al., "Dynamics of Seed Transmission of Plant Pathogens," Annu Rev Phytopathol., 1966, pp. 311-334, vol. 4.

Baltruschat, H., et al., "Salt tolerance of barley induced by the root endophyte Piriformospora indica is associated with a strong increase in antioxidants," New Phytologist., 2008, pp. 501-510, vol. 180.

Block, C. C., et al., "Seed Transmission of Pantoea stewartii in Field and Sweet Corn," Plant Disease, 1998, pp. 775-780, vol. 82.

Brinkmeyer, R., et al., "Uncultured Bacterium Clone ARKMP-100 16S Ribosomal RNA Gene, Partial Sequence," NCBI GenBank Accession No. AF468334, Submitted Jan. 14, 2002.

Brodie, E.L., et al., "Uncultured Bacterium Clone BANW722 16S Ribosomal RNA Gene, Partial Sequence," NCBI GenBank Accession No. DQ264636, Submitted Oct. 25, 2005.

Bulgarelli, D., et al., "Structure and Functions of the Bacterial Microbiota of Plants," Annu Rev Plant Biol., 2013, pp. 807-838, vol. 64.

Caporaso, J.G., et al., "Ultra-High-Throughput Microbial Community Analysis on the Illumina HiSeq and MiSeq Platforms," ISME J., 2012, pp. 1621-1624, vol. 6.

Castillo, D., et al., "Fungal Entomopathogenic Endophytes: Negative Effects on Cotton Aphid Reproduction in Greenhouse and Field Conditions," Power Point Presentation dated Mar. 23, 2013.

Castillo, D., et al., "Fungal Endophytes: Plant Protective Agents Against Herbivores," Power Point Presentation dated Aug. 4, 2013.

Cavalier-Smith, T., "A Revised Six-Kingdom System of Life," Biol Rev Camb Philos Soc., 1998, pp. 203-266, vol. 73.

Cha, C., et al., "Production of Acyl-Homoserine Lactone Quorum-Sensing Signals by Gram-Negative Plant Associated Bacteria," Mol Plant Microbe Interact., 1998, pp. 1119-1129, vol. 11, No. 11.

Chernin, L S., et al., "Chitinolytic Activity in Chromobacterium violaceum: Substrate Analysis and Regulation by Quorum Sensing," J Bacteriol., 1998, pp. 4435-4441, vol. 180, No. 17.

Clark, E. M., et al., "Improved Histochemical Techniques for the Detection of Acremonium coenophilum in Tall Fescue and Methods of in vitro Culture of the Fungus," J. Microbiol Methods, 1983, pp. 149-155, vol. 1.

Clay, K., "Effects of fungal endophytes on the seed and seedling biology of Lolium perenne and Festuca arundinacea," Oecologia, 1987, pp. 358-362, vol. 73.

Clough, S. J., et al., "Floral Dip: A Simplified Method for Agrobacterium-mediated Transformation of Arabidopsis thaliana," Plant J., 1998, pp. 735-743, vol. 16, No. 6.

Coombs, J. T., et al., "Isolation and Identification of Actinobacteda from Surface-Sterilized Wheat Roots," Applied and Environmental Microbiology, 2003, pp. 5603-5608, vol. 69, No. 9.

Conn, V. M., "Effect of Microbial Inoculants on the Indigenous Actinobacterial Endophyte Population in the Roots of Wheats as Determined by Terminal Restriction Fragment Length Polymorphism," Applied and Environmental Microbiology, 2004, pp. 6407-6413, vol. 70, No. 11.

Cottyn, B., et al., "Phenotypic and genetic diversity of rice seed-associated bacteria and their role in pathogenicity and biological control," Journal of Applied Microbiology, 2009, pp. 885-897, vol. 107.

Cox, C. D., "Deferration of Laboratory Media and Assays for Ferric and Ferrous Ions," Methods Enzymol., 1994, pp. 315-329, vol. 235.

Craine, J. M., et al., "Global Diversity of Drought Tolerance and Grassland Climate-Change Resilience," Nature Climate Change, 2013, pp. 63-67, vol. 3.

Dalal, J.M., et al., "Utilization of Endophytic Microbes for Induction of Systemic Resistance (ISR) in Soybean (Glycine max (L) Merril) Against Challenge Inoculation with R. solani," Journal of Applied Science and Research, 2014, pp. 70-84, vol. 2, No. 5.

Danhorn, T., et al., "Biofilm Formation by Plant-Associated Bacteria," Annu Rev Microbiol., 2007, pp. 401-422, vol. 61.

Daniels, R., et al., "Quorum Signal Molecules as Biosurfactants Affecting Swarming in Rhizobium etli," PNAS, 2006, pp. 14965-14970, vol. 103, No. 40.

De Freitas, J. R., et al., "Phosphate-Solubilizing Rhizobacteria Enhance the Growth and Yield but not Phosphorus Uptake of Canola (Brassica napus L.)," Biol Fertil Soils, 1997, pp. 358-364, vol. 24.

De Lima Favaro, L. C., et al., "Epicoccum nigrum P16, a Sugarcane Endophyte, Produces Antifungal Compounds and Induces Root Growth," PLoS One, 2012, pp. 1-10, vol. 7, No. 6.

De Melo Pereira, G. V., et al. "A Multiphasic Approach for the Identification of Endophytic Bacterial in Strawberry Fruit and their Potential for Plant Growth Promotion," Microbial Ecology, 2012, pp. 405-417, vol. 63, No. 2.

De Souza, J. J., et al., "Terpenoids from Endophytic Fungi," Molecules, 2011, pp. 10604-10618, vol. 16, No. 12.

Dennis, C., et al., "Antagonistic Properties of Species Groups of Trichoderma," Trans Brit Mycol Soc, 1971, pp. 25-39, vol. 57, No. 1.

Desiro, A., et al., "Detection of a novel intracellular microbiome hosted in arbuscular mycorrhizal fungi," ISME Journal, 2014, pp. 257-270, vol. 8.

Djordjevic, D., et al., "Microtiter Plate Assay for Assessment of Listeria monocytogenes Biofilm Formation," Annl Environ Microbiol., 2002, pp. 2950-2958, vol. 68, No. 6.

Don, R. H., et al., "Properties of Six Pesticide Degradation Plasmids Isolated From Alcaligenes Paradoxus and Alcaligenes eutrophus," J Bacteriol., 1981, pp. 681-686, vol. 145, No. 2.

Dunbar, J, et al., "Uncultured Bacterium Clone NT42a2_20488 16S Ribosomal RNA Gene, Partial Sequence," NCBI GenBank Accession No. JQ378705. Submitted Nov. 8, 2012.

Eberhard, A., et al., "Structural Identification of Autoinducer of Photobacterium fischeri Luciferase," Biochem., 1981, pp. 2444-2449, vol. 20.

Edgar, R. C., "Search and Clustering Orders of Magnitude Faster than BLAST," Bioinformatics, 2010, pp. 2460-2461, vol. 26, No. 19.

Edgar, R. C., "UPARSE: Highly Accurate OTU Sequences From Microbial Amplicon Reads," Nat Methods, 2013, pp. 996-998, vol. 10, No. 10.

(56) References Cited

OTHER PUBLICATIONS

Ek-Ramos, M. J., "Ecology, Distribution and Benefits of Fungal Endophytes Isolated from Cultivated Cotton (*Gossypium hirsutum*) in Texas," Power Point Presentation dated Nov. 7, 2012.
Ek-Ramos, M. J., et al., "Spatial and Temporal Variation in Fungal Endophyte Communities Isolated from Cultivated Cotton (*Gossypium hirsutum*)," PLoS ONE, 2013, vol. 8, No. 6, 13 Pages.
Ek-Ramos, M. J., et al., "Spatial and Temporal Variation in Fungal Endophyte Communities Isolated from Cultivated Cotton (Gossypium hirsutum)," Power Point Presentation dated Jan. 7, 2013.
El-Shanshoury, A. R., "Growth Promotion of Wheat Seedlings by Streptomyces atroolivaceus," Journal of Agronomy and Crop Science, 1989, pp. 109-114, vol. 163.
Emerson, D., et al., Identifying and Characterizing Bacteria in an Era of Genomics and Proteomics, BioScience, 2008, pp. 925-936, vol. 58, No. 10.
Endre, G., et al., "A Receptor Kinase Gene Regulating Symbiotic Nodule Development," Nature, 2002, pp. 962-966, vol. 417.
Faria, D. C., et al., "Endophytic Bacteria Isolated from Orchid and Their Potential to Promote Plant Growth," World J Microbiol Biotechnol., 2013, pp. 217-221, vol. 29.
Ferrando, L., et al., "Molecular and Culture-Dependent Analyses Revealed Similarities in the Endophytic Bacterial Community Composition of Leaves from Three Rice (*Oryza sativa*) Varieties," FEMS Microbiol Ecol., 2012, pp. 696-708, vol. 80.
Fiehn, O., et al., "Metabolite Profiling for Plant Functional Genomics," Nature Biotechnol., 2000, pp. 1157-1161, vol. 8.
Fierer, N., et al., "Cross-Biome Metagenomic Analyses of Soil Microbial Communities and Their Functional Attributes," Proc Natl Acad Sci USA, 2012, pp. 21390-21395, vol. 109, No. 52.
Fincher, G. B., "Molecular and Cellular Biology Associated with Endosperm Mobilization in Germinating Cereal Grains," Annu Rev Plant Physiol Plant Mol Biol., 1989, pp. 305-346, vol. 40.
Fisher, P. J., et al., "Fungal saprobes and pathogens as endophytes of rice (*Oryza sativa* L.)," New Phytol., 1992, pp. 137-143, vol. 120.
Fisher, P. R., et al., "Isolation and Characterization of the Pesticide-Degrading Plasmid pJP1 from Alcaligenes paradoxus," J Bacteriol., 1978, pp. 798-804, vol. 135, No. 3.
Franco, C., et al., "Actinobacterial Endophytes for Improved Crop Performance," Australasian Plant Pathology, 2007, pp. 524-531, vol. 36.
Fulthorpe, R. R., et al., "Distantly Sampled Soils Carry Few Species in Common," ISME J., 2008, pp. 901-910, vol. 2.
Gantner, S., et al., "Novel Primers for 16S rRNA-based Archaeal Community Analyses in Environmental Samples," J Microbiol Methods, 2011, pp. 12-18, vol. 84.
Gao, Z., et al., "Quantitation of Major Human Cutaneous Bacterial and Fungal Populations," J Clin Microbiol., 2010, pp. 3575-3581, vol. 48, No. 10.
Gasser, I., et al., "Ecology and Characterization of Polyhydroxyalkanoate-Producing Microorganisms on and in Plants," FEMS Microbiol Ecol., 2010, pp. 142-150, vol. 70.
Gavrish, E, et al., "*Lentzea* sp. MS6 16S Ribosomal RNA Gene, Partial Sequence," NCBI GenBank Accession No. EF599958. Submitted May 9, 2007.
Gilmour, S. J., et al., "Overexpression of the *Arabidopsis* CBF3 Transcriptional Activator Mimics Multiple Biochemical Changes Associated with Cold Acclimation," Plant Physiol., 2000, pp. 1854-1865, vol. 124.
Giraldo, A., et al., "Phylogeny of Sarocladium (Hypocreales)," Persoonia, 2015, pp. 10-24, vol. 34.
Gitaitis, R., et al., "The Epidemiology and Management of Seedborne Bacterial Diseases," Annu Rev Phytopathol., 2007, pp. 371-397, vol. 45.
Grondona, I., et al., "TUSAL®, a commercial biocontrol formulation based on Trichoderma," Bulletin OILB/SROP, 2004, pp. 285-288, vol. 27, No. 8.

Gu, O., et al., "*Glycomyces sambucus* sp. nov., an endophytic actinomycete islolated from the stem of Sambucus adnata Wall," International Journal of Systematic and Evolutionary Microbiology, 2007, pp. 1995-1998, vol. 57.
Haake, V., et al., "Transcription Factor CBF4 is a Regulator of Drought Adaptation in *Arabidopsis*," Plant Physiol., 2002, pp. 639-648, vol. 130.
Haas, D., et al., "R Factor Variants with Enhanced Sex Factor Activity in Pseudomonas aeruginosa," Mol Gen Genet., 1976, pp. 243-251, vol. 144.
Hallman, J., et al., "Bacterial Endophytes in Agricultural Crops," Canadian J Microbiol., 1997, pp. 895-914, vol. 43.
Hanson, L.E., "Reduction of Verticillium Wilt Symptoms in Cotton Following Seed Treatment with Trichoderma virens," The Journal of Cotton Science, 2000, pp. 224-231, vol. 4, No. 4.
Hanson, L.E., "Reduction of Verticillium Wilt Symptoms in Cotton Following Seed Treatment with Trichoderma virens," Proceedings Beltwide Cotton Conferences, 2000, vol. 1. (Abstract).
Hardegree, S. P. et al., "Effect of Polyethylene Glycol Exclusion on the Water Potential of Solution-Saturated Filter Paper," Plant Physiol., 1990, pp. 462-466, vol. 92.
Hardoim, P. R., et al., "Assessment of Rice Root Endophytes and Their Potential for Plant Growth Promotion," In: Hardoim, P.R., Bacterial Endophytes of Rice—Their Diversity, Characteristics and Perspectives, Groningen, 2011, pp. 77-100.
Hardoim, P. R., et al., "Dynamics of Seed-Borne Rice Endophytes on Early Plant Growth Stages," PLoS ONE, 2012, vol. 7, No. 2, 13 Pages.
Harman, G.E., et al., "Symposium: biocontrol and biotechnological methods for controlling cotton pests," Proceedings of the Beltwide Cotton Production Research Conf., 1939, Memphis, Tennessee, USA, pp. 15-20. (Abstract).
Hepler, P. K., et al., "Polarized Cell Growth in Higher Plants," Annu Rev Cell Dev Biol., 2001, pp. 159-187, vol. 17.
Hiatt, E. E., et al., "Tall Fescue Endophyte Detection: Commerical Immunoblot Test Kit Compared with Microscopic Analysis," Crop Science, 1999, pp. 796-799, vol. 39.
Hibbett, D. S., et al., "A Higher-Level Phylogenetic Classification of the Fungi," Mycol Res., 2007, pp. 509-547, vol. 111.
Hill, N. S., et al., "Endophyte Survival during Seed Storage: Endophyte-Host Interactions and Heritability," Crop Sci., 2009, pp. 1425-1430, vol. 49.
Hill N. S., et al., "Endophyte Survival during Seed Storage: Endophyte-Host Interactions and Heritability," PowerPoint, Dept. Crop Soil Sciences, University of Georgia, Nov. 16, 2012, 3 Pages.
Hinton, D. M., et al., "Enterobacter cloacae is an endophytic symbiont of corn," Mycopathologia, 1995, pp. 117-125, vol. 129.
Howell, C.R., et al., "Induction of Terpenoid Synthesis in Cotton Roots and Control of Rhizoctonia solani by Seed Treatment with Trichoderma virens," Phytopathology, 2000, pp. 248-252, vol. 90, No. 3.
Hubbard, M., et al., "Fungal Endophytes Improve Wheat Seed Germination Under Heat and Drought Stress," Botany, 2012, pp. 137-149, vol. 90.
Hung, P.Q., et al., "Isolation and Characterization of Endophytic Bacteria in Soybean (*Glycine* Sp.)," Omonrice, 2004, pp. 92-101, vol. 12.
Idris, A., et al., "Efficacy of Rhizobacteria for Growth Promotion in Sorghum Under Greenhouse Conditions and Selected Modes of Action Studies," J Agr Sci., 2009, pp. 17-30, vol. 147.
Ikeda, S., et al., "The Genotype of the Calcium/Calmodulin-Dependent Protein Kinase Gene (CCaMK) Determines Bacterial Community Diversity in Rice Roots Under Paddy And Upland Field Conditions," Applied and Environmental Microbiology, 2011, pp. 4399-4405, vol. 77, No. 13.
Imoto, K., et al., "Comprehensive Approach to Genes Involved in Cell Wall Modifications in *Arabidopsis thaliana*," Plant Mol Biol., 2005, pp. 177-192, vol. 58.
Jalgaonwala, R., et al., "A Review on Microbial Endophytes from Plants: A Treasure Search for Biologically Active Metabolites," Global Journal of Research on Medicinal Plants & Indigenous Medicine, 2014, pp. 263-277, vol. 3, No. 6.

(56) References Cited

OTHER PUBLICATIONS

Janda, J. M., et al., "16S rRNA Gene Sequencing for Bacterial Identification in the Diagnostic Laboratory: Pluses, Perils, and Pitfalls," Journal of Clinical Microbiology, 2007, pp. 2761-2764, vol. 45, No. 9.

Johnston-Monje, D., et al., "Conservation and Diversity of Seed Associated Endophytes in Zea Across Boundaries of Evolution, Ethnography and Ecology," PLoS ONE, 2011, vol. 6, No. 6, 22 Pages.

Johnston-Monje, D., et al., "Plant and Endophyte Relationships: Nutrient Management," Comprehensive Biotechnol., 2011, pp. 713-727, vol. 4.

Johnston-Monje, D., "Microbial Ecology of Endophytic Bacteria in Zea Species as Influenced by Plant Genotype, Seed Origin, and Soil Environment," Thesis, University of Guelph, 2011, 230 Pages.

Jones, K.L., "Fresh Isolates of Actinomycetes in which the Presence of Sporogenous Aerial Mycelia is a Fluctuating Characteristic," J Bacteriol., 1949, pp. 141-145, vol. 57, No. 2.

Kaga, H., et al., "Rice Seeds as Sources of Endophytic Bacteria," Microbes Environ., 2009, pp. 154-162, vol. 24, No. 2.

Kalns, L., et al., "The Effects of Cotton Fungal Endophytes in the Field on Arthropod Community Structure," Power Point Presentation dated Jan. 7, 2013.

Kang, B. H., et al., "Members of the Arabidopsis Dynamin-Like Gene Family, ADL1, are Essential for Plant Cytokinesis and Polarized Cell Growth," Plant Cell, 2003, pp. 899-913, vol. 15.

Kasana, R. C., et al., "A Rapid and Easy Method for the Detection of Microbial Cellulases on Agar Plates Using Gram's Iodine," Curr Microbiol., 2008, pp. 503-507, vol. 57.

Khan, A.L., et al., "Salinity Stress Resistance Offered by Endophytic Fungal Interaction Between Penicillium minioluteum LHL09 and Glycine max. L," J. Microbiol. Biotechnol., 2011, pp. 893-902, vol. 21, No. 9.

Kruger, M., et al., "DNA-Based Species Level Detection of Glomeromycota: One PCR Primer Set for All Arbuscular Mycorrhizal Fungi," New Phvtol., 2009, pp. 212-223, vol. 183.

Kuklinsky-Sobral, J., et al., "Isolation and Characterization of Endophytic Bacteria from Soybean (Glycine max) Grown in Soil Treated with Glyphosate Herbicide," Plant and Soil, 2005, pp. 91-99, vol. 273.

Lanver, D., et al., "Sho1 and Msb2-Related Proteins Regulate Appressorium Development in the Smut Fungus Ustilago aydis," Plant Cell, 2010, pp. 2085-2101, vol. 22.

Laus, M. C., et al., "Role of Cellulose Fibrils and Exopolysaccharides of Rhizobium leguminosarum in Attachment to and Infection of Vicia sativa Root Hairs," Mol Plant Microbe Interact., 2005, pp. 533-538, vol. 18, No. 6.

Le, X.H., et al., "Effects of endophytic Streptomyces on the lucerne (Medicago sativa L.) symbiosis at different levels of nitrogen," 17th Australian Nitrogen Fixation Conference 2014 Proceedings, Sep. 29, 2014, ed. Gupta, V.V.S.R., Unkovich, M. and Kaiser, B. N., ASNF, University of Adelaide, pp. 66-67.

Le, X.H., et al., "Isolation and characterisation of endophytic actinobacteria and their effect on the early growth and nodulation of lucerne (Medicago sativa L.)," 17th Australian Nitrogen Fixation Conference 2014 Proceedings, Sep. 29, 2014, ed. Gupta, V.V.S.R., Unkovich, M. and Kaiser, B. N., ASNF, University of Adelaide, pp. 134-136.

Lehman, S.G., "Treat Cotton Seed," Review of Applied Mycology, 1945, 24, 369.

Lehman, S.G., "Treat Cotton Seed," Research and Farming III, Progr. Rept., 1945, 3, 5.

Leonard, C. A., et al., "Random Mutagenesis of the Aspergillus oryzae Genome Results in Fungal Antibacterial Activity," Int J Microbiol., 2013, vol. 2013, Article ID 901697, 6 Pages.

Li, H. M., et al., "Expression of a Novel Chitinase by the Fungal Endophyte in Poa ampla," Mycologia, 2004, pp. 526-536, vol. 96, No. 3.

Li, H., et al., "Endophytes and their role in phytoremediation," Fungal Diversity, 2012, pp. 11-18, vol. 54.

Li, Q., "Agrobacterium tumefaciens Strain TA-AT-10 16S Ribosomal RNA Gene, Partial Sequence: GenBank: KF673157.1," Submitted Sep. 17, 2013.

Liu, M., et al., "A Novel Screening Method for Isolating Exopolysaccharide-Deficient Mutants," Appl Environ Microbiol., 1998, pp. 4600-4602, vol. 64, No. 11.

Liu, Y., et al., "Investigation on Diversity and Population Succession Dynamics of Endophytic Bacteria from Seeds of Maize (Zea mays L., Nongda108) at Different Growth Stages," Ann Microbiol., 2013, pp. 71-79, vol. 63.

Liu, D., et al., "Osmotin Overexpression in Potato Delays Development of Disease Symptoms," Proc Natl Acad Sci USA, 1994, pp. 1888-1892, vol. 91.

Liu, Y., et al., "Study on Diversity of Endophytic Bacterial Communities in Seeds of Hybrid Maize and their Parental Lines," Arch Microbiol., 2012, pp. 1001-1012, vol. 194.

Long, H. H., et al., "The Structure of the Culturable Root Bacterial Endophyte Community of Nicotiana attenuate is Organized by Soil Composition and Host Plant Ethylene Production and Perception," New Phytol., 2010, pp. 554-567, vol. 185.

Lopez-Lopez, A., et al., "Phaseolus vulgaris Seed-Borne Endophytic Community with Novel Bacterial Species such as Rhizobium endophyticum sp. nov.," Systematic Appl Microbiol., 2010, pp. 322-327, vol. 33.

Lorck, H., "Production of Hydrocyanic Acid by Bacteria," Physiol Plant, 1948, pp. 142-146, vol. 1.

Lugtenberg, B., et al., "Plant-Growth-Promoting Rhizobacteria," Ann. Rev. Microbiol., 2009, pp. 541-556, vol. 63.

Lundberg, D. S., et al., "Defining the Core Arabidopsis thaliana Root Microbiome," Nature, 2012, pp. 86-90, vol. 488, No. 7409.

Lundberg, D. S., et al., "Practical Innovations for High-Throughput Amplicon Sequencing," Nat Methods, 2013, pp. 999-1002, vol. 10, No. 10.

Ma, Y., et al., "Plant Growth Promoting Rhizobacteria and Endophytes Accelerate Phytoremediation of Metalliferous Soils," Biotechnology Advances, 2011, pp. 248-258, vol. 29.

Madi, L. et al., "Aggregation in Azospirillum brasilense Cd: Conditions and Factors Involved in Cell-to-Cell Adhesion," Plant Soil, 1989, pp. 89-98, vol. 115.

Mannisto, M.K, et al., "Characterization of Psychrotolerant Heterotrophic Bacteria From Finnish Lapland," Svst Appl Microbiol., 2006, pp. 229-243, vol. 29.

Mano, H., et al., "Culturable Surface and Endophytic Bacterial Flora of the Maturing Seeds of Rice Plants (Oryza sativa) Cultivated in a Paddy Field," Microbes Environ., 2006, vol. 21, No. 2.

Manter, D. K., et al., "Use of the ITS Primers, ITSIF and ITS4, to Characterize Fungal Abundance and Diversity in Mixed-Template Samples by qPCR and Length Heterogeneity Analysis," J Microbiol Methods, 2007, pp. 7-14, vol. 71.

Mao, W., et al., "Seed Treatment with a Fungal or a Bacterial Antagonist for Reducing Corn Damping-off Caused by Species of Pythium and Fusarium," Plant Disease, 1997, pp. 450-454, vol. 81, No. 5.

Marasco, R., et al., "A Drought Resistance-Promoting Microbiome is Selected by Root System Under Desert Farming," PLoS ONE, 2012, vol. 7, No. 10, 14 Pages.

Marquez, L. M., et al., "A Virus in a Fungus in a Plant: Three-Way Symbiosis Required for Thermal Tolerance," Science, 2007, pp. 513-515, vol. 315.

Mastretta, C., et al., "Endophytic Bacteria from Seeds of Nicotiana Tabacum Can Reduce Cadmium Phytotoxicity," Intl J Phytoremediation, 2009, pp. 251-267, vol. 11.

Mateos, P. F., et al., "Cell-Associated Pectinolytic and Cellulolytic Enzymes in Rhizobium leguminosarum biovar trifolii," Appl Environ Microbiol., 1992, pp. 816-1822, vol. 56, No. 6.

McDonald, D., et al., "An Improved Greengenes Taxonomy with Explicit Ranks for Ecological and Evolutionary Analyses of Bacteria and Archaea," ISME J., 2012, pp. 610-618, vol. 6.

McGuire, K.L., et al., "Digging the New York City Skyline: Soil Fungal Communities in Green Roofs and City Parks," PLoS One, 2013, vol. 8, No. 3, 13 Pages.

(56) References Cited

OTHER PUBLICATIONS

Medina, P., et al., "Rapid Identification of Gelatin and Casein Hydrolysis Using TCA," J Microbiol Methods, 2007, pp. 391-393, vol. 69.
Mehnaz, S., et al., "Growth Promoting Effects of Corn (Zea mays) Bacterial Isolates Under Greenhouse and Field Conditions," Soil Biology and Biochemistry, 2010, pp. 1848-1856, vol. 42.
Mehnaz, S., et al., "Isolation and 16S rRNA sequence analysis of the beneficial bacteria from the rhizosphere of rice," Canada Journal of Microbiology, 2001, pp. 110-117, vol. 47, No. 2.
Mei, C., et al., "The Use of Beneficial Microbial Endophytes for Plant Biomass and Stress Tolerance Improvement," Recent Patents on Biotechnology, 2010, pp. 81-95, vol. 4.
Michel, B. E., et al., "The Osmotic Potential of Polyethylene Glycol 6000," Plant Physiol., 1973, pp. 914-916, vol. 51.
Moe, L. A., "Amino Acids in the Rhizosphere: From Plants to Microbes," American Journal of Botany, 2013, pp. 1692-1705, vol. 100, No. 9.
Mohiddin, F. A., et al., "Tolerance of Fungal and Bacterial Biocontrol Agents to Six Pesticides Commonly Used in the Control of Soil Borne Plant Pathogens," African Journal of Agricultural Research, 2013, pp. 5331-5334, vol. 8, No. 43.
Mousa, W. K., et al., "The Diversity of Anti-Microbial Secondary Metabolites Produced by Fungal Endophytes: An Interdisciplinary Perspective," Front Microbiol., 2013, vol. 4, No. 65, 18 Pages.
Mundt, J.O., et al., "Bacteria Within Ovules and Seeds," Appl Environ Microbiol., 1976, pp. 694-698, vol. 32, No. 5.
Naik, B. S., et al., "Study on the diversity of endophytic communities from rice (Oryza sativa L.) and their antagonistic activities in vitro," Microbiological Research, 2009, pp. 290-296, vol. 164.
Naveed, M., "Maize Endophytes—Diversity, Functionality and Application Potential," University of Natural Resources and Life Sciences, 2013, pp. 1-266 and 81-87; Tables 1-3; Figure 2.
Nejad, P. et al., "Endophytic Bacteria Induce Growth Promotion and Wilt Disease Suppression in Oilseed Rape and Tomato," Biological Control, 2000, pp. 208-215, vol. 18.
Neslon, E.B., "Microbial Dynamics and Interactions in the Spermosphere," Ann. Rev. Phytopathol., 2004, pp. 271-309, vol. 42.
Nikolcheva, L.G., et al., "Taxon-Specific Fungal Primers Reveal Unexpectedly High Diversity During Leaf Decomposition in a Stream," Mycological Progress, 2004, pp. 41-49, vol. 3, No. 1.
Nimnoi, P., et al., "Co-Inoculation of Soybean (Glycin Max) with Actinomycetes and Bradyrhizobium Japonicum Enhances Plant Growth, Nitrogenase Activity and Plant Nutrition," Journal of Plant Nutrition, 2014, pp. 432-446, vol. 37.
Normander, B., et al., "Bacterial Origin and Community Composition in the Barley Phytosphere as a Function of Habitat and Presowing Conditions," Appl Environ Microbiol., Oct. 2000, pp. 4372-4377, vol. 66, No. 10.
Okunishi, S., et al., "Bacterial Flora of Endophytes in the Maturing Seeds of Cultivated Rice (Oryza sativa)," Microbes and Environment, 2005, pp. 168-177, vol. 20, No. 3.
Orole, O. O., et al., "Bacterial and fungal endophytes associated with grains and roots of maize," Journal of Ecology and the Natural Enviomment, 2011, pp. 298-303, vol. 3, No. 9.
Partida-Martinez, L.P., et al., "The Microbe-Free Plant: Fact or Artifact?" Front Plant Sci., 2011, vol. 2, No. 100, 16 Pages.
Pearson, W.R., et al., "Rapid and Sensitive Sequence Comparison With FASTP and FASTA," Methods Enzymol., 2011, pp. 63-98, vol. 183.
Pedraza, R. O., et al., "Azospirillum inoculation and nitrogen fertilization effect on grain yield and on the diversity of endophytic bacteria in the phyllosphere of rice rainfed crop," European Journal of Soil Biology, 2009, pp. 36-43, vol. 45.
Perez-Fernandez, M. A., et al., "Simulation of Germination of Pioneer Species Along an Experimental Drought Gradient," J Environ Biol., 2006, pp. 669-685, vol. 27, No. 4.
Perez-Miranda, S., et al., "O-CAS, A Fast and Universal Method for Siderophore Detection," J Microbiol Methods, 2007, pp. 127-131, vol. 70.
Petti, C. A., "Detection and Identification of Microorganisms by Gene Amplification and Sequencing," Clinical Infectious Diseases, 2007, pp. 1108-1114, vol. 44.
Phalip, V., et al., "A Method for Screening Diacetyl and Acetoin-Producing Bacteria on Agar Plates," J Basic Microbiol.,1994, pp. 277-280, vol. 34.
Philippot, L., et al., "Going Back to the Roots: The Microbial Ecology of the Rhizosphere," Nat Rev Microbiol., Nov. 2013, pp. 789-799, vol. 11.
Philrice Batac, Philippine Rice R&D Highlights, 2012, Area-Based R&D Projects, [online][Retrieved Aug. 11, 2016] Retrieved from the Internet <URL:http://www.philrice.gov.ph/2012-rd-highlights/>.
Pillay, V. K., et al., "Inoculum Density, Temperature, and Genotype Effects on in vitro Growth Promotion and Epiphytic and Endophytic Colonization of Tomato (Lycopersicon esculentum L.) Seedlings Inoculated with a Pseudomonad Bacterium," Can J Microbiol., 1997, pp. 354-361, vol. 43.
Powell, W. A., et al., "Evidence of Endophytic Beauveria Bassiana in Seed-Treated Tomato Plants Acting as a Systemic Entomopathogen to Larval Helicoverpa zea (Lepidoptera: Noctuidae)," J. Entomol. Sci., 2009, pp. 391-396, vol. 44, No. 4.
Quadt-Hallmann, A., et al., "Bacterial Endophytes in Cotton: Mechanisms of Entering the Plant," Can J Microbiol., 1997, pp. 577-582, vol. 43.
R Core Team, "R: A Language and Environment for Statistical Computing," R Foundation for Statistical Computing, Vienna, Austria, May 2013, ISBN: 3-900051-07-0. Available online at http://www.R- 25project.org/, 3604 Pages.
Rasmussen, S., et al., "Grass-endophyte interactions: a note on the role of monosaccharide transport in the Neotyphodium lolii-Lolium perenne symbiosis," New Phytologist, 2012, pp. 7-12, vol. 196.
Ravel, C., et al., "Beneficial effects of Neotyphodium lolii on the growth and the water status in perennial ryegrass cultivated under nitrogen deficiency or drought stress," Agronomie, 1997, pp. 173-181, vol. 17.
Redman, R. S., et al., "Thermotolerance Generated by Plant/Fungal Symbiosis," Science, Nov. 2002, vol. 298, 1 Page (with 4 pages of supplemental material).
Reiter, B., et al., "Response of Endophytic Bacterial Communities in Potato Plants to Infection with Erwinia carotovora subsp. atroseptica," Appl Environ Microbiol., 2001, pp. 2261-2268, vol. 68, No. 5.
Rodriguez, H., et al., "Expression of a Mineral Phosphate Solubilizing Gene From Erwinia herbicola in Two Rhizobacterial Strains," J Biotechnol., 2001, pp. 155-161, vol. 84.
Rodriguez, R.J., et al., "Stress Tolerance in Plants via Habitat-Adapted Symbiosis," ISME J., 2008, pp. 404-416, vol. 2.
Rodriguez-Navarro, D., et al., "Soybean Interactions with Soil Microbes, Agronomical and Molecular Aspects," Agronomy for Sustainable Development, 2011, pp. 173-190, vol. 31, No. 1.
Roessner, U., et al., "Metabolic Profiling Allows Comprehensive Phenotyping of Genetically or Environmentally Modified Plant Systems," Plant Cell, 2001,pp. 11-29, vol. 13.
Rosado, A. S., et al., "Phenotypic and Genetic Diversity of Paenibacillus azotofixans Strains Isolated from the Rhizoplane or Rhizosphere Soil of Different Grasses," J App Microbiol., 1998, pp. 216-226, vol. 84.
Rosenblueth, A., et al., "Seed Bacterial Endophytes: Common Genera, Seed-to-Seed Variability and Their Possible Role in Plants," Acta Hort., 2012, pp. 39-48, vol. 938.
Rosenblueth, M., et al., "Bacterial Endophytes and Their Interactions With Host," Molecular Plant-Microbe Interactions, 2006, pp. 827-837, vol. 19, No. 8.
Ross, P.L., et al., "Multiplexed Protein Quantitation in Saccharomyces cerevisiae Using Amine-Reactive Isobaric Tagging Reagents," Mol Cell Proteomics, 2004, pp. 1154-1169, vol. 3, No. 12.
Saleem, M., et al., "Perspective of Plant Growth Promoting Rhizobacteria (PGPR) Containing ACC Deaminase in Stress Agriculture," J Ind Microbiol Biotechnol., Oct. 2007, pp. 635-648, vol. 34.

(56) References Cited

OTHER PUBLICATIONS

Samac, D.A., et al., "Recent Advances in Legume-Microbe Interactions: Recognition, Defense Response, and Symbiosis from a Genomic Perspective," Plant Physiol., 2007, pp. 582-587, vol. 144.
Sardi, P., et al., "Isolation of Endophytic Streptomyces Strains from Surface Sterilized Roots," Applied and Environmental Microbiology, 1992, pp. 2691-2693, vol. 58, No. 8.
Sarwar, M., et al., "Tryptophan Dependent Biosynthesis of Auxins in Soil," Plant Soil, 1992, pp. 207-215, vol. 147.
Schmieder, R., et al., "Quality Control and Preprocessing of Metagenomic Datasets," Bioinformatics, 2011, pp. 863-864, vol. 27, No. 6.
Schoch, C. L., et al., "Nuclear Ribosomal Internal Transcribed Spacer (ITS) Region as a Universal DNA Barcode Marker for Fungi," Proc Natl Acad Sci USA, 2012, pp. 6241-6246, vol. 109, No. 16.
Schwyn, B. et al., "Universal Chemical Assay for the Detection and Determination of Siderophores," Analytical Biochemistry, 1987, pp. 47-56, vol. 160.
Sessitsch, A., et al., "*Burkholderia phytofirmans* sp. Nov., a novel plant-associated bacterium with plant-beneficial properties," International Journal of Systematic and Evoluntary Microbiology, 2005, pp. 1187-1192, vol. 55.
Shapiro-Ilan, D.I., et al., "The Potential for Enhanced Fungicide Resistance in Beauveria Bassiana Through Strain Discovery and Artificial Selection," Journal of Invertebrate Pathology, 2002, pp. 86-93, vol. 81.
Shankar, M., et al.,"Root colonization of a rice growth promoting strain of Enterobacter cloacae," Journal of Basic Microbiology, 2011, pp. 523-530, vol. 51.
Singh, A. K., et al., "Uncultured *Actinomyces* sp. Clone EMLACT 80 IV (New) 16S Ribosomal RNA Gene, Partial Sequence," NCBI GenBank Accession No. JQ285908. Submitted Dec. 13, 2011.
Soares, M. M. C. N., et al., "Screening of Bacterial Strains for Pectinolytic Activity: Characterization of the Polygalacturonase Produced by Bacillus SP," Revista de Microbiolgia, 1999, pp. 299-303, vol. 30.
Soe, K.M., et al., "Effects of endophytic actinomycetes and Bradyrhizobium japonicum strains on growth, nodulation, nitrogen fixation and seed weight of different soybean varieties," Soil Science and Plant Nutrition, 2012, pp. 319-325, vol. 58, No. 3.
Soe, K.M., et al., "Low-Density Co-Inoculation of Myanmar Bradyrhizobium yuanmingense MAS34 and Streptomyces griseoflavus P4 to Enhance Symbiosis and Seed Yield in Soybean Varieties," American Journal of Plant Sciences, 2013, pp. 1879-1892, vol. 4.
Song, M., et al., "Effects of Neotyphodium Endophyte on Germination of Hordeum brevisubulatum under Temperature and Water Stress Conditions," Acta Agrestia Sinica, 2010, pp. 834-837, vol. 18, No. 6. (English Abstract).
Souleimanov, A., et al., "The Major Nod Factor of Bradyrhizobium japonicum Promotes Early Growth of Soybean and Corn," J. Exp. Bot., 2002, pp. 1929-1934, vol. 53, No. 376.
Spiekermann, P., et al., "A Sensitive, Viable-Colony Staining Method Using Nile Red for Direct Screening of Bacteria that Accumulate Polyhydroxyalkanoic Acids and Other Lipid Storage Compounds," Arch Microbiol., 1999, pp. 73-80, vol. 171.
Staudt, A. K., et al., "Variations in Exopolysaccharide Production by Rhizobium tropici," Arch Microbiol., 2012, pp. 197-206, vol. 194.
Strobel, G. A., "Endophytes as Sources of Bioactive Products," Microbes and Infection, 2003, pp. 535-544, vol. 5.
Sturz, A. V., et al., "Weeds as a Source of Plant Growth Promoting Rhizobacteria in Agricultural Soils," Can J Microbiol., 2001, pp. 1013-1024, vol. 47, No. 11.
Surette, M. A., et al. "Bacterial Endophytes in Processing Carrots (*Daucus carota* L. var. *sativus*): Their Localization, Population Density, Biodiversity and Their Effects on Plant Growth," Plant and Soil, 2003, pp. 381-390, vol. 253, No. 2.
Suto, M., et al., "Endophytes as Producers of Xylanase," J Biosci Bioeng., 2002, pp. 88-90, vol. 93, No. 1.

Sword, G., "Manipulating Fungal Endophytes to Protect Plants from Insects and Nematodes," Power Point Presentation dated Aug. 7, 2013.
Sword, G., et al., "Manipulating Fungal Endophytes for the Protection of Cotton in the Field," Power Point Presentation dated Jan. 7, 2013.
Sword, G., et al., "Field Trials of Potentially Beneficial Fungal Endophytes in Cotton," Power Point Presentation dated Jan. 7, 2013.
Sword, G., "Fungal Endophytes to Protect Cotton from Insects and Nematodes," Power Point Presentation dated Dec. 7, 2012.
Sword, G., "Natural Enemies—The Forgotten Basis of IPM?," Power Point Presentation dated Sep. 6, 2013.
Taghavi, S., et al., "Genome Survey and Characterization of Endophytic Bacteria Exhibiting a Beneficial Effect on Growth and Development of Poplar Trees," Applied and Environmental Microbiology, 2009, pp. 748-757, vol. 75, No. 3.
Taylor, A. G., et al., "Concepts and Technologies of Selected Seed Treatments," Annu. Rev. Phytopathol., 1990, pp. 321-339, vol. 28.
Teather, R. M., et al., "Use of Congo Red-Polysaccharide Interactions in Enumeration and Characterization of Cellulolytic Bacteria from the Bovine Rumen," Appl Environ Microbiol., 1982, pp. 777-780, vol. 43, No. 4.
Theis, K. R., et al., "Uncultured Bacterium Clone GM2GI8201A64RC 16S Ribosomal RNA Gene, Partial Sequence," NCBI GenBank Accession No. JX051943, Submitted May 14, 2012.
Thomas, L., et al., "Development of Resistance to Chlorhexidine Diacetate in Pseudomonas aeruginosa and the Effect of a "Residual" Concentration," J Hosp Infect., 2000, pp. 297-303, vol. 46.
Thomashow, M. F., "So What's New in the Field of Plant Cold Acclimation? Lots!," Plant Physiol., 2001, pp. 89-93, vol. 125.
Tokala, R. T., et al., "Novel Plant-Microbe Rhizosphere Interaction Involving Streptomyces Lydicus WYEC108 and the Pea Plant (Pisum Sativum)," Applied and Environmental Microbiology, May 2002, pp. 2161-2171, vol. 68, No. 5.
Trichoderma definition, 2016, [online] [Retrieved on Sep. 16, 2016,] Retrieved from the Internet <URL:https://en.wikipedia.org/wiki/Trichoderma>.
Trotel-Aziz, P., et al., "Characterization of New Bacterial Biocontrol Agents Acinetobacter, Bacillus, *Pantoea* and *Pseudomonas* spp. Mediating Grapevine Resistance Against Botrytis cinerea," Environmental and Experimental Botany, 2008, pp. 21-32, vol. 64.
Truyens, S., et al., "Changes in the Population of Seed Bacteria of Transgenerationally Cd-Exposed *Arabidopsis thaliana*," Plant Biol., 2013, pp. 971-981, vol. 15.
Usadel, B., et al., "The Plant Transcriptome-From Integrating Observations to Models," Front Plant Sci., 2013, pp. 1-3, vol. 4., Article 48, 3 Pages.
Vacheron, J., et al., "Plant Growth-Promoting Rhizobacteria and Root System Functioning," Frontiers Plant Sci., 2013, vol. 4, Article 356, 19 Pages.
Valencia, C. U., et al., "Endophytic Establishment as an Unintended Consequence of Biocontrol with Fungal Entomopathogens," Power Point Presentation dated Jan. 7, 2013.
Van Der Lelie, D., et al., "Poplar and its Bacterial Endophytes: Coexistence and Harmony," Critical Rev Plant Sci., 2009, pp. 346-358, vol. 28.
Vining, K., et al., "Methylome Reorganization During in vitro Dedifferentiation and Regeneration of Populus trichocarpa," BMC Plant Biol., 2013, vol. 13, No. 92, 15 Pages.
Viruel, E., et al., "Pseudomonas thiveralensis Strain IEHa 16S Ribosomal RNA Fene, Partial Sequence," NCBI GenBank Accession No. GQ169380.1, Submitted May 15, 2009.
Waller, F., et al., "The Endophytic Fungus Piriformospora indica Reprograms Barley to Salt-Stress Tolerance, Disease Resistance, and Higher Yield," PNAS, 2005, pp. 13386-13391, vol. 102, No. 38.
Wang, B., et al., "Fungal endophytes of native *Gossypium* species in Australia," Mycological Research, 2007, pp. 347-354, vol. 111, No. 3.
Wang, K., et al., "Monitoring in Planta Bacterial Infection at Both Cellular and Whole-Plant Levels Using the Green Fluorescent Protein Variant GFPuv," New Phytol., 2007, pp. 212-223, vol. 174.

(56) References Cited

OTHER PUBLICATIONS

Wang, Q., et al., "Naive Bayesian Classifier for Rapid Assignment of rRNA Sequences into the New Bacterial Taxonomy," Appl. Environ. Microbiol., 2007, pp. 5261-5267, vol. 73, No. 16.
Waqas, M., et al., "Endophytic Fungi Produce Gibberellins and Indoleacetic Acid and Promotes Host-Plant Growth during Stress," Molecules, 2012, pp. 10754-10773, vol. 17.
Weaver, P.F., et al., "Characterization of Rhodopseudomonas capsulata," Arch Microbiol., 1975, pp. 207-216, vol. 105.
Weindling, R., "Relation of dosage to control of cotton seedling diseases by seed treatment," Plant Disease Reporter, 1943, 27, 68-70.
Welty, R.E., et al., "Influence of Moisture Content, Temperature, and Length of Storage on Seed Germination and Survival of Endophytic Fungi in Seeds of Tall Fescue and Perennial Ryegrass," Phytopathyol., 1987, pp. 893-900, vol. 77, No. 6.
White, J. F., et al., "A Proposed Mechanism for Nitrogen Acquisition by Grass Seedlings Through Oxidation of Symbiotic Bacteria," Symbiosis, 2012, pp. 161-171, vol. 57.
Wiegand, I., et al., "Agar and Broth Dilution Methods to Determine the Minimal Inhibitory Concentration (MIC) of Antimicrobial Substances," Nature Protocols, 2008, pp. 163-175, vol. 3, No. 2.
Xu, M., et al., "Bacterial Community Compositions of Tomato (*Lycopersicum esculentum* Mill.) Seeds and Plant Growth Promoting Activity of ACC Deaminase Producing Bacillus subtilis (HYT-12-1) on Tomato Seedlings," World J Microbiol Biotechnol., 2014, pp. 835-845, vol. 30.
Xu, Y., et al., "Biosynthesis of the Cyclooligomer Despipeptide bassianolide, an Insecticidal Virulence Factor of Beauverja bassiana," Fungal Genetics and Biology, 2009, pp. 353-364, vol. 46.
Xue, Q.Y., et al., "Evaluation of the Strains of Acinetobacter and Enterobacter as potential Biocontrol Agents Against Ralstonia Wilt of Tomato," Biological Control, 2009, vol. 48, pp. 252-258.
Yandigeri, M. S., et al., "Drought-tolerant endophytic actinobacteria promote growth of wheat (*Triticum aestivum*) under water stress conditions," Plant Growth Regulation, 2012, pp. 411-420, vol. 68.
Yezerski, A., et al., "The Effects of the Presence of Stored Product Pests on the Microfauna of a Flour Community," Journal of Applied Microbiology, 2005, pp. 507-515, vol. 98.
You, Y., et al., "Analysis of Genomic Diversity of Endophytic Fungal Strains Isolated from the Roots of Suaeda japonica and S. maritima for the Restoration of Ecosystems in Buan Salt Marsh," Korean Journal of Microbiology and Biotechnology, 2012, pp. 287-295, vol. 40, No. 4. (with English Abstract).
Zhou, W., et al., "Effects of the Fungal Endophyte *Paecilomyces* sp. in Cotton on the Roo-Knot Nematode Meloidogyne incognita," poster dated Jan. 7, 2013.
Zimmerman, N.B., et al., "Fungal Endophyte Communities Reflect Environmental Structuring Across a Hawaiian Landscape," Proc Natl Acad Sci USA, 2012, pp. 13022-13027, vol. 109, No. 32.
Zuccaro, A., et al., "Endophytic Life Strategies Decoded by Genome and Transcriptome Analyses of the Mutualistic Root Symbiont Piriformospora indica," PLOS Pathogens, 2011, vol. 7, No. 10, e1002290.
Zuniga, A., et al., "Quorum Sensing and Indole-3-Acetic Acid Degradation Play a Role in Colonization and Plant Growth Promotion of *Arabidopsis thaliana* by Burkholderia phytofirmans PsJN," Mol Plant Microbe Interact., 2013, pp. 546-553, vol. 26, No. 5.
Abdellatif, L., et al., "Characterization of virulence and PCR-DGGE profiles of Fusarium avenaceum from western Canadian Prairie Ecozone of Saskatchewan," Canadian Journal of Plant Pathology, 2010, pp. 468-480.
Abdou, R., et al., "Botryorhodines A-D, antifungal and cytotoxic depsidones from Botryosphaeria rhodina, an endophyte of the medicinal plant Bidens pilosa," Phytochemistry, 2010, vol. 71, pp. 110-116.
Abou-Shanab, R. A., et al: "Characterization of Ni-resistant bacteria in the rhizosphere of the hyperaccumulator Alyssum murale by 16S rRNA gene sequence analysis", World Journal of Microbiology and Biotechnology, vol. 26, No. 1, Aug. 15, 2009, pp. 101-108.

Adhikari, M., et al., "A New Record of Pseudeurotium bakeri from Crop Field Soil in Korea," The Korean Journal of Mycology, 2016, pp. 145-149, vol. 44.
Alvarez-Perez, S., et al., "Zooming-in on floral nectar: a first exploration of nectar-associated bacteria in wild plant communities," FEMS Microbiol. Ecol., 2012, vol. 80, No. 3, pp. 591-602.
Amatuzzi, R.F., et al., "Univers1dade Federal Do Parana," Jan. 1, 2014, 52 Pages. (With English Abstract).
Amatuzzi, R.F., et al., "Potential of endophytic fungi as biocontrol agents of Duponchelia fovealis (Zeller) (Lepidoptera:Crambidae)," Brazilian Journal of Biology, Nov. 9, 2017, 7 Pages.
Antony-Badu, S., et al., "Multiple *Streptomyces* species with distinct secondary metabolomes have identical 16S rRNA gene sequences." Scientific Reports 7.1, Sep. 2017, No. 7, 11089, pp. 1-8.
Artursson, V., et al., "Interactions between arbuscular mycorrhizal fungi and bacteria and their potential for stimulating plant growth", Environmental Microbiology, vol. 8, No. 1, Jan. 1, 2006, pp. 1-10.
Aveskamp, M., et al., "DNA phylogeny reveals polyphyly of Phoma section Peyronellaea and multiple taxonomic novelties," Mycologia, 2009, vol. 101, No. 3, pp. 363-382.
Azcon, R., et al., "Selective interactions between different species of *mycorrhizal fungi* and *Rhizobium meliloti* strains, and their effects on growth, N2-fixation (15N) and nutrition of *Medicago sativa* L.," New PhytoL., 1991, vol. 117, pp. 399-404.
Bensch, K., et al., "Species and ecological diversity within the Cladosporium cladosporioides complex (Davidiellaceae, Capnodiales)," Studies in Mycology, 2010, pp. 1-94, vol. 67.
Bethlenfalvay, G., et al., "Mycorrhizal fungi effects on nutrient composition and yield of soybean seeds", Journal of Plant Nutrition, vol. 20, No. 4-5, Apr. 1, 1997, pp. 581-591.
Bing, LA, et al., "Suppression of Ostrinia nubilalis (Hübner) (Lepidoptera: Pyralidae) by endophytic Beauveria bassiana (Balsamo) Vuillemin", Environmental Entomol, Entomological Society of America, College Park, MD, US, vol. 20, Jan. 1, 1991, pp. 1207-1211.
Bragantia, et al: "Identificaqao E Avaliaqao De Rizobacterias Isoladas De Raizes De Milho," Jan. 1, 2010, pp. 905-911, Retrieved from the Internet: URL:http://www.scielo.br/pdf/brag/v69n4/v69n4a17.pdf (With English Abstract).
Chagas, F., et al., "A Mixed Culture of Endophytic Fungi Increases Production of Antifungal Polyketides," J. Chem Ecol., Oct. 2013, pp. 1335-1342, vol. 39.
Clarridge, J., "Impact of 16S rRNA Gene Sequence Analysis for Identification of Bacteria on Clinical Microbiology and Infectious Diseases," Clinical Microbiology Reviews, Oct. 2004, pp. 840-862, vol. 17, No. 4.
Compant, S., et al., "Endophytic colonization of *Vitis vinfera* L. by Burkholderia phytofirmans strain PsJN: from the rhizosphere to inflorescence tissues," FEMS Microbiol Ecol, 2008, pp. 84-93, vol. 63.
DBGET, "Orthology: K14454," 2005, 2 pages, can be retrieved at <URL:http://www.genome.jp/dbget-bin/www_bget?ko:K14454>.
De Medeiros, L., et al., "Evaluation of Herbicidal Potential of Depsides from Cladosporium uredinicola an Endophytic Fungus found in Guava Fruit," J. Braz. Chem. Soc., 2012, vol. 23, No. 8, p. 1551-1557.
Fox, G., et al., "How close is close: 16S rRNA sequence identity may not be sufficient to guarantee species identity." International Journal of Systematic and Evolutionary Microbiology 42.1, 1992, pp. 166-170.
Garazzino, S., et al., "Osteomyelitis Caused by Enterobacter cancerogenus Infection following a Traumatic Injury: Case Report and Review of the Literature," J Clin Microbiol., Mar. 2005, vol. 43, No. 3, pp. 1459-1461.
Gebhardt, J., et al., "Characterization of a single soybean cDNA encoding cytosolic and glyoxysomal isozymes of aspartate aminostransferase," Plant Molecular Biology, 1998, pp. 99-108, vol. 37.
GenBank: AF034210.1 "Glycine max aspartate aminotransferase glyoxysomal isozyme AAT1 precursor and aspartate aminotransferase cytosolic isozyme AAT2 (AAT) mRNA, complete cds," NCBI, May 26, 1998, 2 Pages, can be retrieved at <URL:https://www.ncbi.nlm.nih.gov/nuccore/AF034210>.

(56) References Cited

OTHER PUBLICATIONS

GenBank: JN210900.1, "*Enterobacter* sp. WS05 16S ribosomal RNA gene, partial sequence," NCBI, Sep. 24, 2012, 1 Page, can be retrieved at <URL:https://www.ncbi.nlm.nih.gov/nuccore/jn210900>.

GenBank: NP_001237541.1, "aspartate aminotransferase glyoxysomal isozyme AAT1 precursor [Glycine max]," NCBI, Oct. 29, 2016, 2 Pages, can be retrieved at <URL:https://www.ncbi.nlm.nih.gov/protein/NP_001237541.1>.

NCBI GenBank: CP000653.1 "*Enterobacter* sp. 638, complete genome" Jan. 28, 2014, 5 Pages, Can be retrieved at <URL:https://www.ncbi.nlm.nih.gov/nuccore/CP000653.1>.

NCBI GenBank: CP000653.1 "*Enterobacter* sp. 638, complete genome" ASM1632v1, Apr. 18, 2007, 2 Pages, Can be retrieved at <URL:https://www.ncbi.nlm.nih.gov/assembly/GCA_000016325.1>.

NCBI GenBank: EU340965.1 "*Enterobacter* sp. 638 16S ribosomal RNA gene, partial sequence" Jan. 30, 2009, 1 Page, Can be retrieved at <URL:https://www.ncbi.nlm.nih.gov/nuccore/EU340965.1>.

NCBI GenBank: EBI accession No. EM STD:JQ759988, "*Dothideomycetes* sp. genotype 226 isolate FL0175 internal transcribed spacer 1, partial sequence; 5.8S ribosomal RNA gene and internal transcribed spacer 2, complete sequence; and 28S ribosomal RNA gene, partial sequence," May 17, 2012, 2 Pages.

NCBI GenBank: EBI accession No. EM STD:GU055658, "Uncultured Periconia clone NG R 806 18S ribosomal RNA gene, partial sequence; internal transcribed spacer 1, 5.8S ribosomal RNA gene, and internal transcribed spacer 2, complete sequence; and 28S ribosomal RNA gene, partial sequence," Oct. 27, 2009, 2 Pages.

GenEmbl Database, GenEmbl Record No. KF673660, Sandberg, et al., "Fungal endophytes of aquatic macrophytes: diverse host-generalists characterized by tissue preferences and geographic structure," 2013, 35 Pages.

GenEmbl Database, GenEmbl Record No. KP991588, Huang, et al., "Pervasive effects of wildfire on foliar endophyte communities in montane forest trees," Mar. 2015, 35 Pages.

GenEmbl Database, GenEmbl Record No. JN872548, 38 Pages, Alvarez-Perez, S., et al., "Zooming-in on floral nectar: a first exploration of nectar-associated bacteria in wild plant communities," FEMS Microbiol. Ecol., 2012, vol. 80, No. 3, pp. 591-602.

GenEmbl database, GenEmbl Record No. EU 977189, Jan. 21, 2009, 4 pages, Smith, S.A., et al., "Bioactive endophytes warrant intensified exploration and conservation," PloS ONE 3(8):E3052, 2008.

GenEmbl database, GenEmbl Record No. KF011597, Paenibacillus strain No. HA 13, Aug. 26, 2013, 5 Pages, Park, H.J., et al., "Isolation and characterization of humic substances-degrading bacteria from the subarctic Alaska grasslands," J Basic Microbiol, 2013.

Database Geneseq Database accession No. BAP97938 "Pantoea dispersa strain KACC91642P 16S rDNA sequence, Seq ID 1." Aug. 15, 2013, 1 Page.

Database Embl [Online] Oct. 1, 2001, 2 Pages, "Setosphaeria monoceras 28S ribosomal RNA gene, partial sequence," XP002777918, retrieved from EBI accession No. EM_STD:AY016368 Database accession No. AY016368 sequence.

NCBI, GenBank Accession No. XP_002568042, Aug. 14, 2009, 4 Pages, Berg, V.D., et al., "Genome sequencing and analysis of the filamentous fungus," Nat. Biotechnol. 26 (10), 1161-1168 (2008).

Goudjal, Y., et al., "Biocontrol ofRhizoctonia solanidamping-off and promotion of tomato plant growth by endophytic actinomycetes isolated from native plants of Algerian Sahara", Microbiological Research, 2014, vol. 169, No. 1 , pp. 59-65.

Gup, X., et al., "Red Soils Harbor Diverse Culturable Actinomycetes That Are Promising Sources of Novel Secondary Metabolites", Applied and Environmental Microbiology, Feb. 27, 2015, vol. 81, No. 9, pp. 3086-3103.

Hahm, M-S., et al., "Biological Control and Plant Growth Promoting Capacity of Rhizobacteria and Pepper Under Greenhouse and Field Conditions," The Journal of Microbiology, The Microbiological Society of Korea, Heidelberg, Jun. 30, 2012, pp. 380-385, vol. 50, No. 3.

Hain, T., et al., "Chitinolytic transgenes from Streptomyces albidoflavus as phytochemicals defences against herbivorous insects, use in transgenic plants and effect in plant development", International Journal of Systematic Bacteriology, Jan. 1997, vol. 47, No. 1, pp. 202-206.

Hamayun, M., et al., "Cladosporium sphaerospermum as a new plant growth-promoting endophyte from the roots of Glycine max (L.) Merr," World Journal of Microbiology and Biotechnology, Kluwer Academic Publishers, Feb. 15, 2009, pp. 627-632, vol. 25, No. 4.

Hanshew, A., et al., "Characterization of Actinobacteria Associated with Three Ant-Plant Mutualisms", Microbial Ecology, Aug. 6, 2017, vol. 69, No. 1, pp. 192-203.

Hjort, K., et al., "Chitinase genes revealed and compared in bacterial isolates, DNA extracts and a metagenomic library from a phytopathogen-suppressive soil", FEMS Microbiology Ecology, Feb. 2010, vol. 71, No. 2, pp. 197-207.

Hoffman, M., et al., "Diverse Bacteria Inhabit Living Hyphae of Phylogenetically Diverse Fungal Endophytes," Applied and Environmental Microbiology, Jun. 2010, p. 4063-4075, vol. 76, No. 12.

Hoffman, M., et al., "Endohyphal Bacterium Enhances Production of Indole-3-Acetic Acid by a Foliar Fungal Endophyte," PLOS One, Sep. 24, 2013, pp. 1-8, vol. 8, Issue 9, e73132.

Hubbard, M., et al., 2011. "Agricultural Potential of Fungal Endophytes of Grasses, Cereals and Wheat," In: Wheat: Genetics, Crops and Food Production. Nova Science Publishers Hauppauge, NY, USA. pp. 333-345.

Humann, J., et al., "Complete genome of the onion pathogen Enterobacter cloacae EcWSU1," Standard in Genomic Sciences, Dec. 31, 2011, vol. 5, No. 3, pp. 279-286.

Impullitti, A.E., et al., "Fungal endophyte diversity in soybean", Journal of Applied Microbiolog, vol. 114, No. 5, May 1, 2013, pp. 1500-1506.

Jung, C., et al., "The Effects of Endohyphal Bacteria on Anti-Cancer and Anti-Malaria Metabolites of Endophytic Fungi," Honors Thesis, University of Arizona, May 2012, 15 Pages.

Kanbar, A., et al., "Relationship between Root and Yield Morphological Characters in Rainfed Low Land Rice (*Oryza sativa* L.)," Cereal Research Communications, 2009, vol. 37, No. 2, pp. 261-268.

Klaubauf, S., et al., "Molecular diversity of fungal communities in agricultural soils from Lower Austria," Fungal Diversity, Aug. 13, 2010, pp. 65-75, vol. 44, No. 1.

Knapp, D., et al., "Inter- and intraspecific functional diversity of fungal root endophytes of semiarid sandy grasslands," Acta Microbiologica et Immunologica Hungarica, Nov. 2017, pp. 1-101, vol. 64, Issue Supplement 1.

Kuklinsky-Sobral, J., et al., "Isolation and characterization of soybean-associated bacteria and their potential for plant growth promotion," Environmental Microbiology, 2004, pp. 1244-1251, vol. 6, No. 12.

Kumar, S., et al., "MEGA7: Molecular Evolutionary Genetics Analysis version 7.0 for bigger datasets," Molecular Biology and Evolution, Mar. 22, 2016, vol. 33, pp. 1870-1874.

Kumar, A., et al., "Bio-control potential of *Cladosporium* sp. (MCPL-461), against a noxious weed *Parthenium hysterophorus* L.," J. Environ Biol., Mar. 2009, pp. 307-312, vol. 30, Issue 2.

Kusari, S., et al. "Chemical ecology of endophytic fungi: origins of secondary metabolites," Cell Press, Chem & Biol., 2012, pp. 792-798, vol. 19.

Labeda, D.P., et al., "Phylogenetic study of the species within the family *Streptomycetaceae*," Antonie van Leeuwenhoek, 2012, vol. 101, pp. 73-104, Springer.

Li, M., et al., "ATP Modulates the Growth of Specific Microbial Strains", Current Microbiology, May 30, 2010, vol. 62, No. 1, pp. 84-89.

Liu, Y., et al., "Phylogenetic relationships among ascomycetes: evidence from an RNA polymerase II subunit," Mol. Biol. Evol. 1999. vol. 16, No. 12, pp. 1799-1808.

(56) References Cited

OTHER PUBLICATIONS

Mandyam, K., et al., "Mutualism-parasitism paradigm synthesized from results of root-endophyte models", Frontiers in Microbiology, Jan. 12, 2015, pp. 1-14, vol. 5.
Misk, A., et al., "Biocontrol of chickpea root rot using endophytic actinobacteria", Biocontrol, vol. 56, No. 5, Mar. 12, 2011, pp. 811-822, XP036215297.
Miyoshi-Akiyama, T., et al., "Multilocus Sequence Typing (MLST) for Characterization of Enterobacter cloacae," PLoS ONE, 2013, vol. 8, No. 6, 10 Pages, e66358.
Nassar, A., et al., "Promotion of plant growth by an auxin-producing isolate of the yeast Williopsis saturnus endophytic in maize (*Zea mays* L.) roots", Biology and Fertility of Soils; Cooperating Journal of International Society of Soil Science, Springer, Berlin, DE, vol. 42, No. 2, Nov. 1, 2005, pp. 97-108.
Nishijima, K.A., et al., "Demonstrating Pathogenicity of Enterobacter cloacae on Macadamia and Identifying Associated Volatiles of Gray Kernel of Macadamia in Hawaii," Plant Disease, Oct. 2007, vol. 91, No. 10, pp. 1221-1228.
Ogbo, F., et al., "Some Characteristics of a Plant Growth Promoting *iEnterobacter*/isp. Isolated from the Roots of Maize", Advances in Microbiology, Jan. 1, 2012, vol. 02, No. 03, pp. 368-374.
O'Hanlon, K., et al., "Exploring the potential of symbiotic fungal endophytes in cereal disease suppression", Biological Control, vol. 63, No. 2, Sep. 5, 2012, pp. 69-78.
Op De Beeck, M., et al., "Comparison and Validation of Some ITS Primer Pairs Useful for Fungal Metabarcoding Studies," PLOS ONE, Jun. 2014, vol. 9, Issue 6, e97629, pp. 1-11.
Rae, R., et al., "A subset of naturally isolated Bacillus strains show extreme virulence to the free-living nematodes Caenorhabditis elegans and Pristionchus pacificus", Environmental Microbiology, 2010, pp. 3007-3021, vol. 12, No. 11.
Ren, Y., et al., "Complete Genome Sequence of *Enterobacter cloacae* subsp. *cloacae* Type Strain ATCC 13047," J. Bacteriol. May 2010, vol. 192, No. 9, pp. 2463-2464.
Riess, K., et al., "High genetic diversity at the regional scale and possible speciation in *Sebacina epigaea* and *S. incrustans*," BMC Evolutionary Biology, 2013, vol. 13, No. 102, 17 Pages.
Riken, GI No. GMFL01-01-003, 2 Pages, [online] [Retrieved on Dec. 18, 2017] Retrieved from the internet <URL:http://spectra.psc.riken.jp/menta.cgi/rsoy/datail?id=GMFL01-01-D03>.
Samways, M.J., et al., "Assessment of the Fungus Cladosporium Oxyspoum (Berk. And Curt.) As a Potential BioControl Agent Against Certain Homoptera," Elsevier Science Publioshers B.V., Jan. 1, 1986, pp. 231-239.
Saunders, M., et al., "Host-Synthesized Secondary Compounds Influence the In Vitro Interactions between Fungal Endophytes of Maize", Applied and Environmental Microbiology, Nov. 9, 2007, pp. 136-142, vol. 74 , No. 1.
NCBI, GenBank Accession No. KX641980.1, Jul. 29, 2017, Scott, M., et al., "*Dothideomycetes* sp. isolate FT14-6 internal transcribed spacer 1, partial sequence; 5.8S ribosomal RNA gene and internal transcribed spacer 2, complete sequence; and large subunit ribosomal RNA gene, partial sequence," 2 Pages, Can be retrieved at <URL:https://www.ncbi.nlm.nih.gov/nuccore/KX641980>.
Senthilkumar, M., et al., "Biocontrol Potential of Soybean Bacterial Endophytes Against Charcoal Rot Fungus, Rhizoctonia bataitola," Current Microbiology, 2009, vol. 58, pp. 288-293.
Shiraishi, A., et al., "Nodulation in black locust by the ammaproteobacteria *Pseudomonas* sp. and the Betaproteobacteria *Burkholderia* sp", Systematic and Applied Microbiology, Aug. 2010, pp. 269-274, vol. 33, No. 3.
Simola, L., et al., "The Effect of Some Protein and Non-Protein Amino Acids on the Growth of Cladosporium herbarum and Trichotheeium roseum," Effect of Amino Acids on Fungi, Physiologia Plantarum, 1979, pp. 381-387, vol. 46.
Sogonov, M.V., et al., "The hyphomycete *Teberdinia hygrophila* gen. nov., sp. nov. and related anamorphs of *Pseudeurotium* species," Mycologia, May 2005, pp. 695-709, vol. 97, No. 3.

Stielow, J.B., et al., "One fungus, which genes? Development and assessment of universal primers for potential secondary fungal DNA barcodes," Persoonia: Molecular Phylogeny and Evolution of Fungi, 2015, vol. 35, pp. 242-263.
Taghavi, S., et al., "Genome Sequence of the Plant Growth promoting Endophytic Bacterium *Enterobacter* sp. 638", PLoS Genet., May 2010, pp. 1-15, vol. 6, Issue 5, e1000943.
Tamura, K., et al., "Estimation of the number of nucleotide substitutions in the control region of mitochondrial DNA in humans and chimpanzees," Molecular Biology and Evolution, 1993, vol. 10, No. 3, pp. 512-526.
Thakur, A., et al., "Detrimental effects of endophytic fungus *Nigrospora* sp. on survival and development of Spodoptera litura," Biocontrol Science and Technology, Feb. 1, 2012, pp. 151-161, vol. 22, No. 2.
Thakur, A., et al., "Enhanced Resistance to Spodoptera litura in Endophyte Infected Cauliflower Plants," Environmental Entomology, Apr. 1, 2013, pp. 240-246, vol. 42, No. 2.
Thakur, A., et al., "Suppression of Cellular Immune Response in Spodoptera litura (Lepidoptera: Noctuidae) Larvae by Endophytic Fungi Nigrospora oryzae and Cladosporium uredinicola,", Annals of the Entomological Society of America, May 1, 2014, pp. 674-679, vol. 107, No. 3.
U'Ren, J.M., et al., "Host and geographic structure of endophytic and endolichenic fungi at the continental scale," American Journal of Botany, May 1, 2012, pp. 898-914, vol. 99, No. 5.
Valencia, E., et al., "Mini-review: Brazilian fungi diversity for biomass degradation," Fungal Genetics and Biology, 2013, pp. 9-18, vol. 60.
Verkley, G., et al., "Paraconiothyrium, a new genus to accommodate the *mycoparasite Coniothyrium minitans*, anamorphs of *Paraphaeosphaeria*, and four new species," Studies in Mycology, 2004, pp. 323-335, vol. 50.
Visagie, C.M., et al., "Identification and nomenclature of the genus *Penicillium*," Studies in Mycology, Jun. 2014, pp. 343-371, vol. 78.
Vujanovic, V., et al., "Viability Testing of Orchid Seed and the Promotion of Colouration and Germination," Annals of Botany, Mar. 17, 2000, pp. 79-86, vol. 86.
Vujanovic, V., et al., "Endophytic hyphal compartmentalization is required for successful mycobiont-wheat interaction as revealed by confocal laser microscopy," The proceedings of the Soils and Crops conference in Saskatoon (2008) published 2009, 7 Pages.
Vujanovic, V., et al., "A comparative study of endophytic mycobiota in leaves of Acer saccharum in eastern North America," Mycological Progress, May 2002, pp. 147-154, vol. 1, Issue 2.
Vujanovic, V., et al.,"Orchid seed viability testing by fungal bioassays and molecular phylogeny," Floriculture, ornamental and plant biotechnology, 2006, vol. 63, pp. 563-569.
Vujanovic, V., et al., "Mycovitality—a new concept of plant biotechnology," Canadian Journal Plant Pathol, 2007, vol. 29, p. 451.
Vujanovic, V., et al., "19th International Conference on *Arabidopsis*. Research Proceedings—ICAR13," Jul. 23-27, 2008, 264 Pages, Montreal, QC, Canada.
Vujanovic, V., et al., "Mycovitality and mycoheterotrophy: where lies dormancy in terrestrial orchid and plants with minute seeds?" Symbiosis, 2007, vol. 44, pp. 93-99.
Vujanovic, V., et al., "Seed endosymbiosis: a vital relationship in providing prenatal care to plants," Can. J. Plant Sci., NRC Research Press, Feb. 6, 2017, pp. 972-981, vol. 97.
Vujanovic, V., et al: "Fungal communities associated with durum wheat production system: A characterization by growth stage, plant organ and preceding crop", Crop Protection, Elsevier Science, GB, vol. 37, Feb. 19, 2012, pp. 26-34.
Youssef, Y.A., et al., "Production of Plant Growth Substances by Rhizosphere Myoflora of Broad Bean and Cotton," Biologia Plantarum, 1975, pp. 175-181, vol. 17, No. 3.
Zhang, Y., et al., BcGsl, a glycoprotein from Botrytis cinerea, elicits defence response and improves disease resistance in host plants. Biochemical and biophysical research communications, Biochemical and Biophysical Research Communications, 2015, vol. 457, No. 4, pp. 627-634.
Zhang, W., et al., Host range of Exserohilum monoceras, a potential bioherbicide for the control of *Echinochloa* species, Canadian

(56) References Cited

OTHER PUBLICATIONS

Journal of Botany/ Journal Canadien De Botan, National Research Council, Ottawa, CA, vol. 75, Jan. 1, 1997, pp. 685-692.

Zhang, J., et al: "Isolation and Characterization of Plant Growth-Promoting Rhizobacteria from Wheat Roots by Wheat Germ Agglutinin Labeled with Fluorescein Isothiocyanate", The Journal Of Microbiology, Apr. 27, 2012, vol. 50, No. 2, pp. 191-198, GenBank Accession No. JN210900.

Zhao, J.H., et al., "Bioactive secondary metabolites from *Nigrospora* sp. LLGLM003, an endophytic fungus of the medicinal plant Moringa oleifera Lam." World Journal of Microbiology and Biotechnology, Kluwer Academic Publishers, Feb. 12, 2012, pp. 2107-2112, vol. 28, No. 5.

Zhu et al., *Helminthosporium velutinum* and *H. aquaticum* sp. nov. from aquatic habitats in Yunnan Province, China. Phytotaxa, 2016, vol. 253, No. 3, pp. 179-190.

\* cited by examiner

Figure 1
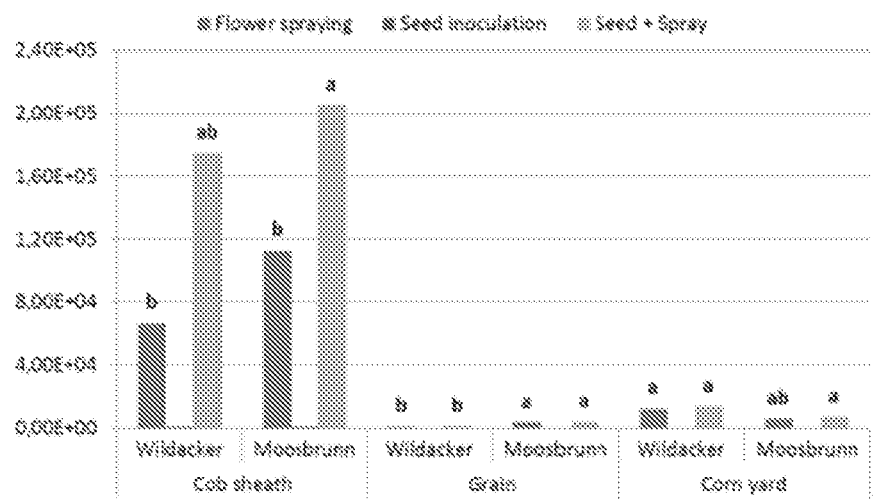
Figure 2.
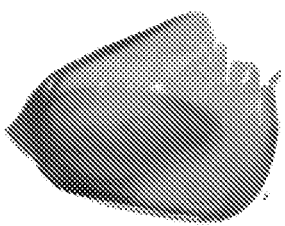
Fig. 2a
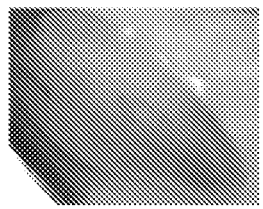
Fig. 2b
Fig. 2c Figure 3
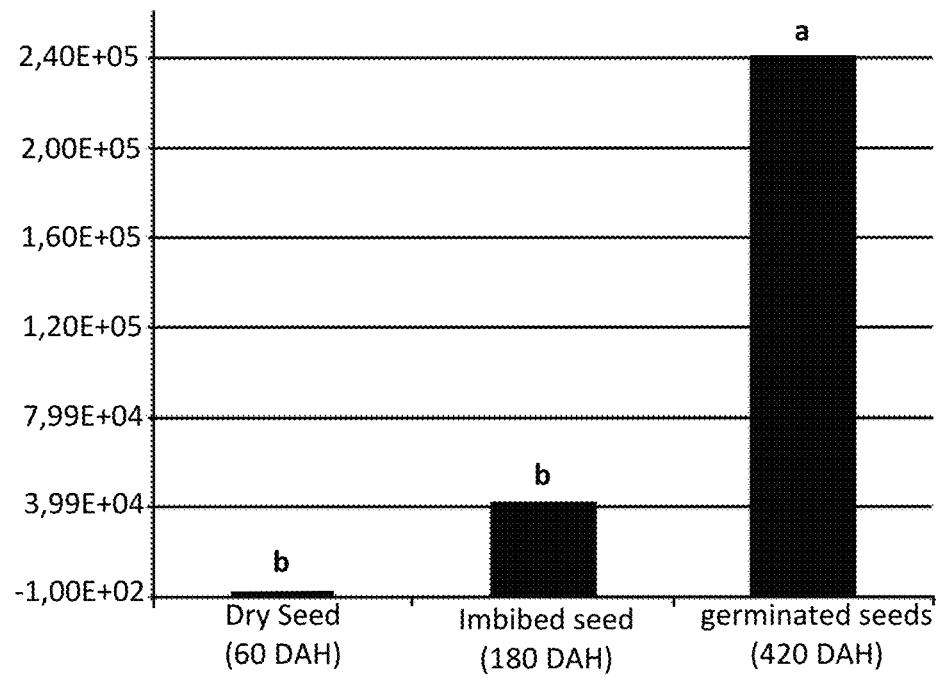
Figure 4
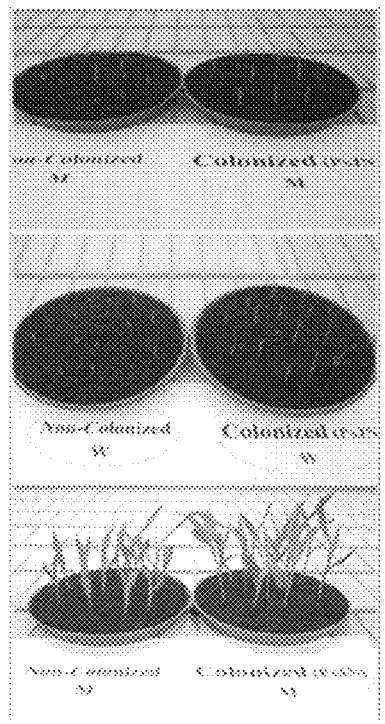
Fig. 4a
Fig. 4b
Fig. 4c

A)

B)

C)

| Rep 3 | Border | V3 1624 | V1 1625 | V2 1626 | Border |
| Rep 2 | Border | V2 1621 | V3 1622 | V1 1623 | Border |
| Rep 3 | Border | V1 1618 | V2 1619 | V3 1620 | Border |

A)

B)

A)

B)

C)

PLANTS CONTAINING BENEFICIAL ENDOPHYTES

JOINT RESEARCH AGREEMENT

Symbiota, Inc., (now Indigo Ag, Inc.) and the Austrian Institute of Technology GmbH, were subject to a joint research agreement effective on or before the effective filing date of the claimed invention.

SEQUENCE LISTING

The instant application contains a Sequence Listing which has been filed electronically in ASCII format and is hereby incorporated by reference in its entirety. Said ASCII copy, created on Jun. 24, 2015, is named 28273PCT_SL.txt and is 1,164,153 bytes in size.

TECHNICAL FIELD

This application relates to methods and materials for providing a benefit to a seed or seedling of an agricultural plant, or an agricultural plant derived from the seed or seedling. For example, this application provides purified microbial populations that include microbial endophytes, and synthetic combinations of seeds and/or seedlings with seed-derived microbial endophytes such as heterologous seed-derived microbial endophytes. Such seed microbial endophytes can provide beneficial properties to the seed, seedling, or the agricultural plant derived from the seed or seedling, including beneficial properties related to metabolic, transcriptional, or proteome alterations, morphology, and the resilience to a variety of environmental stresses, and combination of such properties.

BACKGROUND

The present invention relates to the methods of producing plant seeds comprising microbes, as well as compositions of plants and seed comprising microbes.

Agriculture faces numerous challenges that are making it increasingly difficult to provide food, materials, and fuels to the world's population. Population growth and changes in diet associated with rising incomes are increasing global food demand, while many key resources for agriculture are becoming increasingly scarce. By 2050, the FAO projects that total food production must increase by 70% to meet the needs of the growing population, a challenge that is exacerbated by numerous factors, including diminishing freshwater resources, increasing competition for arable land, rising energy prices, increasing input costs, and the likely need for crops to adapt to the pressures of a more extreme global climate. The need to grow nearly twice as much food in more uncertain climates is driving a critical need for new innovations.

Today, crop performance is optimized via of technologies directed towards the interplay between crop genotype (e.g., plant breeding, genetically-modified (GM) crops) and its surrounding environment (e.g., fertilizer, synthetic herbicides, pesticides). While these paradigms have assisted in doubling global food production in the past fifty years, yield growth rates have stalled in many major crops and shifts in the climate have been linked to production declines in important crops such as wheat. In addition to their long development and regulatory timelines, public fears of GM-crops and synthetic chemicals has challenged their use in many key crops and countries, resulting in a complete lack of acceptance for GM traits in wheat and the exclusion of GM crops and many synthetic chemistries from European markets. Thus, there is a significant need for innovative, effective, and publically-acceptable approaches to improving the intrinsic yield and resilience of crops to severe stresses.

Like humans, which benefit from a complement of beneficial microbial symbionts, plants have been purported to benefit somewhat from the vast array of bacteria and fungi that live both within and around their tissues to support their health and growth. Endophytes are fungal or bacterial organisms that live within plants. Bacterial and fungal endophytes appear to inhabit various host plant tissues and have been isolated from plant leaves, stems, or roots. There is an increasing appreciation of the roles played by microbes, including endophytic bacteria, in improving plant growth, health and productivity. For example, association with certain microbes can promote plant growth using an array of mechanisms, including playing an essential role in biological nitrogen fixation (BNF), the synthesis of phytohormones and vitamins, increasing the host plant's tolerance to numerous environmental stresses (including both biotic and abiotic stresses), alteration of hormone production, as well as increasing the bioavailability to the plant of macro- and micronutrients such as phosphorus and iron.

Endophytic organisms associated with plants occupy a relatively privileged niche within a plant and contribute to plant health or growth. Endophytes have been targeted as valuable sources of new bioactive compounds. Endophytes inhabit plant tissues, particularly the so-called intercellular space. Endophytic microorganisms have been found in virtually every plant studied, where they colonize the internal tissues of their host plant and can form a range of different relationships including symbiotic, mutualistic, commensalistic and trophobiotic. Most endophytes appear to originate from the rhizosphere or phyllosphere; however, some may be transmitted through the seed. Endophytic microorganisms can promote plant growth and yield and can act as biocontrol agents. Endophytes can also be beneficial to their host by producing natural products that are beneficial to the plant and could also be harnessed for potential use in medicine, agriculture or industry. In addition, it has been shown that they have the potential to remove soil contaminants by enhancing phytoremediation and may play a role in soil fertility through phosphate solubilization and nitrogen fixation. There is increasing interest in developing the potential biotechnological applications of endophytes for improving phytoremediation and the sustainable production of non-food crops for biomass and biofuel production.

Numerous attempts are known which aimed at improving the establishment of transferring beneficial microbes to another plant: these efforts include the coating of seeds with microbes, application of microbes to the soil, or even direct injection of the microbes into plant stems or leaves, as well as foliar application of microbes. Seed treatment (soaking and embedding in carrier material) with bacterial inocula prior to sowing is one method of inoculation. Peat (carrier based mixing) inoculants have been used to apply microbes to plants; however, several other commercial preparations have been marketed. Crop Genetics International Ltd. developed a seed inoculation technique by applying a pressure differential to infuse the bacterial suspension into imbibed seeds and re-drying the seeds (U.S. Pat. No. 5,415,672 A).

However, these conventional methods suffer from variability stemming from the reduced viability of microbes through the processing of the microbes, including drying, fertilizer contact, seed coat toxicity, incompatible pesticidal and mineral additives, or long periods of storage in varying environmental conditions (e.g., heat, humidity, etc.). Likewise, several soil and environmental stresses affect the survival/colonization efficiency of the inoculant strains. Bacterial population density, the host plant species, agronomic practices and climatic conditions are among the important factors for the success of biological plant colonization.

Moreover, current inoculation methods of microbial colonization of plants with the desired microorganisms have proven difficult and often yield inconsistent results, making it difficult to apply this technology on an industrial scale. For example, microorganisms used in seed coating often do not survive well or are unable to colonize the plant (because the microorganisms on the outside can be hindered in entering the seed or plant). If the plant is mechanically (or otherwise) wounded to provide an entry, this can put the health of the seed, seedlings or plant at risk, because harmful microorganisms could enter the plant as well in an unprotected manner. Moreover, even if the microorganisms can colonize a given plant, there can be a natural loss of viability and the efficiency of colonization can be low. More complex inoculation techniques (e.g., by applying vacuum or pressure infiltration, inoculation by injection, etc.) are also causing risk for the plant and are—most importantly—challenging to transfer to a large scale or industrial applicability and are thus not effective.

Therefore, there is a need to produce plants with improved traits without genetic modification. There is also a need to provide plants and seeds with defined additions to their endophyte populations.

SUMMARY

The present invention is based on the surprising discovery that microbes can be viably incorporated into the seeds of plants by inoculation of various plant tissues. The inventors have discovered that, when a preparation of microorganisms is applied to the flower of a plant under defined conditions, the microorganisms can gain entry when grain formation starts and establish populations inside, and hence colonize the seed. The methods described herein can be used to introduce microbes, including heterologous microbes and microbes that are able to confer beneficial traits, into plants and their seeds. The methods also can produce plants and seeds with greater uniformity of many properties when compared with methods employing the coating of seeds with microbes. In addition, these methods can be used to generate plants with improved traits, for example, improved overall health and higher tolerance for biotic and abiotic stresses. Also provided are novel compositions of plants, plant parts and seeds containing microbes.

In some aspects, disclosed herein is a method for generating an agricultural seed preparation, comprising: (a) contacting at least one flower of a plurality of agricultural plants with a synthetic formulation comprising a purified bacterial population, the bacterial population comprising a bacterial endophyte in an amount effective to colonize the at least one seed made by the flower, wherein the bacterial endophyte exhibits the ability to produce or induce in the at least one seed made by the flower, or in a seedling or an agricultural plant grown from the at least one seed, a functional activity selected from at least two of: catalase activity, oxidase activity, casein hydrolysis activity, gelatin hydrolysis activity, ACC-deaminase activity, exopolysaccharide activity, amylase activity, cellulase activity, chitinase activity, hemolytic activity, lipase activity, pectinase activity, phosphatase activity, protease activity, xylanase activity, production of an auxin, production of an antimicrobial, production of HCN, production of NH3, production of AHL, production of PHB, production of a siderophore, mineral phosphate solubilization, and production of acetoin.

In some embodiments, the bacterial endophyte is present in the colonized seed in an amount capable of providing a benefit to the seed or to agricultural plants derived from the seeds, as compared to a reference seed, seedling or plant.

In certain embodiments, the flower is a male flower.

In other embodiments, the flower is a female flower.

In yet other embodiments, the bacterial endophyte is present in an amount effective to colonize at least one additional tissue selected from the group consisting of the peduncle, the pedicarp, the placenta and the embryo.

In additional embodiments, the bacterial endophyte is present in at least at least two compartments of the seed selected from the group consisting of the embryo, the seed coat, the endosperm, the cotyledon, the hypocotyl, the radicle, and the cotyledons.

In a further aspect the method further comprises (b) packaging the contacted seeds in a container.

In some embodiments, the formulation further comprises a stabilizer, a fungicide, a preservative, or a combination thereof.

In further embodiments, the bacterial endophyte is selected from the group consisting of a bacterial endophyte derived from a stress adapted plant or the environment thereof, a bacterial endophyte derived from the same plant species as the plant to which the formulation is contacted, and a bacterial endophyte derived from a different plant species as the plant to which the formulation is contacted.

In other embodiments, the bacterial endophyte is capable of specifically localizing in a tissue of a seed made by the flower, a seedling grown from the seed or an agricultural plant grown from the seed.

In some embodiments, the bacterial endophyte is capable of localizing in a tissue selected from the group consisting of the embryo of the seed, the root of the seedling or plant, and the shoot of the seedling or plant.

In some embodiments, the benefit is the alteration in the population of microbes present in the seed or plant.

In other embodiments, the alteration in the population of microbes is an increase in the number of bacteria of the Comamonadaceae or Xanthomonadaceae families.

In yet other embodiments, the alteration in the population of microbes is a decrease in the number of bacteria of the Actinomycetaceae, Chitinophagaceae, Phyllobacteriaceae, Microbacteriaceae, Exiguobacteraceae, Sphingomonadaceae, Phyllobacteriaceae, or Enterobacteriaceae families.

In yet other embodiments, the alteration in the population of microbes is the appearance of at least one microbe that is not present within the reference seed, seedling or plant, in addition to the bacterial endophyte.

In additional embodiments, the at least one microbe that is not present within the reference seed, seedling or plant is of the Kineosporiaceae, Weeksellaceae, Geodermatophilaceae, Bacillaceae, Thermicanus, Weeksellaceae, or Geodermatophilaceae families.

In other embodiments, the alteration in the population of microbes is the disappearance of at least one microbe that is present within the reference seed, seedling or plant.

In yet other embodiments, the at least one microbe that is present within the reference seed, seedling or plant is of the Chitinophagaceae or Alcaligenaceae families.

In additional embodiments, the bacterial endophyte is amplified within a tissue of the agricultural plant.

In further embodiments, the contacted seeds are packaged in the container such that they are substantially stable at about 25 degrees C. for at least 7 days.

In further embodiments, the bacterial endophyte is present in the synthetic combination in an amount effective to increase the level of at least one protein involved in resistance against abiotic stress within the seed, a seedling derived from the seed or a cereal agricultural plant derived from the seed, as compared to a reference seed, seedling or plant.

In additional embodiments, the protein involved in resistance against abiotic stress is a protein selected from those involved in response to heavy metals, proteins associated with ion transport and proteins involved in salt stress and water stress tolerance.

In some embodiments, the protein is a ribosomal protein.

In further embodiments, the bacterial endophyte is present in the synthetic combination in an amount effective to increase the level of at least one protein involved in symbiosis within the seed, a seedling derived from the seed or a cereal agricultural plant derived from the seed, as compared to a reference seed, seedling or plant.

In some embodiments, the protein involved in symbiosis is involved in a protein involved in the defense or establishment of symbiosis with microbes.

In further embodiments, the protein is involved in pathogen response, ribosomal protein, protein homologous to those involved in nodule formation in legumes, and protein associated with micorrhiza.

In yet further embodiments, the bacterial endophyte is present in the synthetic combination in an amount effective to increase the level of at least one protein involved in growth promotion within the seed, a seedling derived from the seed or a cereal agricultural plant derived from the seed, as compared to a reference seed, seedling or plant.

In some embodiments, the protein involved in growth promotion is selected from the group consisting of elongation factors, proteins related to nutrient acquisition and proteins involved in chromosomal segregation during mitosis.

In further embodiments, the contacting in (a) comprises spraying, immersing, or dusting the flowers with the formulation.

In additional embodiments, the purified bacterial population comprises a plurality of bacterial endophyte entities.

In further embodiments, the purified bacterial population comprises a plurality of taxonomically diverse bacterial endophyte entities.

In yet further embodiments, the bacterial population comprises a bacterial endophyte comprising a 16S nucleic acid sequence at least 97% identical to a bacterial endophyte selected from Tables 1-5 or 16.

In yet further embodiments, the purified bacterial population comprises i) a first bacterial endophyte comprising a first 16S nucleic acid sequence at least 97% identical to a bacterial endophyte selected from Table 1-5 or 16, and ii) a second bacterial endophyte comprising a second 16S nucleic acid sequence at least 97% identical to a bacterial endophyte selected from Table 1-5 or 16, wherein the first and second 16S nucleic acid sequence are not 100% identical.

In some embodiments, the first bacterial endophyte and the second bacterial endophyte synergistically increase at least one of overall biomass, plant height, number of leaves per plant, shoot biomass, root biomass, germination rate, germination index, germination energy, coefficient of uniform germination, and yield.

In some embodiments, the contacting results in a concentration of at least 10 CFU of the bacterial endophyte inside the seed.

In further embodiments, the bacterial population is obtained from a plant species other than that of the flowers to which the formulation is contacted.

In yet further embodiments, the bacterial population is obtained from the same plant species as that of the flowers to which the formulation is contacted.

In yet further embodiments, the bacterial population is obtained from a plant cultivar or a seed thereof different from the cultivar of the flowers to which the formulation is contacted.

In yet further embodiments, the bacterial population is obtained from a surface sterilized seed.

In additional embodiments, the bacterial population provides a benefit capable of being maternally inherited by progeny of the seeds produced by the flowers to which the formulation is contacted.

In additional embodiments, the bacterial population provides a benefit capable of being paternally inherited by progeny of the seeds produced by the flowers to which the formulation is contacted.

In further embodiments, the bacterial population is derived or obtained from i) a rice, maize, wheat, soy, or barley seed, or ii) from an agricultural plant grown from a rice, maize, wheat, soy, or barley seed.

In further embodiments, the bacterial population is derived or obtained from a monocot seed.

In further embodiments, the bacterial population is derived or obtained from a dicot seed.

In additional embodiments, the contacted plant seed has at least one activity selected from at least two phenotypes or activities selected from the group consisting of catalase activity, oxidase activity, casein hydrolysis activity, gelatin hydrolysis activity, ACC-deaminase activity, exopolysaccharide activity, amylase activity, cellulase activity, chitinase activity, hemolytic activity, lipase activity, pectinase activity, phosphatase activity, protease activity, xylanase activity, production of an auxin, production of an antimicrobial, production of HCN, production of NH3, production of AHL, production of PHB, production of a siderophore, mineral phosphate solubilization, and production of acetoin.

In additional embodiments, the contacted plant seed has at least one activity selected from at least two phenotypes or activities selected from the group consisting of catalase activity, oxidase activity, casein hydrolysis activity, gelatin hydrolysis activity, ACC-deaminase activity, exopolysaccharide activity, amylase activity, cellulase activity, chitinase activity, hemolytic activity, lipase activity, pectinase activity, phosphatase activity, protease activity, xylanase activity, production of an auxin, production of an antimicrobial, production of HCN, production of NH3, production of AHL, production of PHB, production of a siderophore, mineral phosphate solubilization, and production of acetoin, and ii) inducing in the agricultural plant and/or the agricultural plant seed a change in expression of a protein selected from the group consisting of: proteins involved in growth promotion, proteins with involved in plant involved in tolerance against abiotic stress, proteins involved in the defense of symbiosis, proteins involved in the establishment of symbiosis.

In further embodiments, the protein involved in growth promotion is a protein selected from the group consisting of proteins elongation factors, proteins related to nutrient acquisition and proteins involved in chromosomal segregation during mitosis.

In other embodiments, the protein involved in tolerance against abiotic stress is a protein selected from the group consisting of proteins involved in response to heavy metals, proteins associated with ion transport, proteins involved in salt stress tolerance and proteins involved in water stress tolerance.

In additional embodiments, the protein involved in the defense of symbiosis is a protein involved in pathogen response.

In other embodiments, the protein involved in the establishment of symbiosis is a protein selected from the group consisting of ribosomal proteins, proteins homologous to those involved in nodule formation in legumes, and proteins associated with micorrhiza.

In additional embodiments, the benefit is selected from the group consisting of: increased root biomass, increased root length, increased height, increased shoot length, increased leaf number, increased water use efficiency, increased overall biomass, increased yield, increased germination rate, decreased time to start germination, decreased mean germination time, decreased time to 50% germination, decreased time to final germination, increased germination index, increased germination energy, increased coefficient of uniform germination, photosynthesis rate, tolerance to drought, heat tolerance, salt tolerance, resistance to nematode stress, resistance to a fungal pathogen, resistance to a bacterial pathogen, resistance to a viral pathogen, altered metabolite expression, and altered protein expression, relative to reference seeds or agricultural plants derived from the reference seeds.

In additional embodiments, the benefit comprises at least two benefits selected from the group consisting of: increased root biomass, increased root length, increased height, increased shoot length, increased leaf number, increased water use efficiency, increased overall biomass, increased yield, increased germination rate, decreased time to start germination, decreased mean germination time, decreased time to 50% germination, decreased time to final germination, increased germination index, increased germination energy, increased coefficient of uniform germination, photosynthesis rate, tolerance to drought, heat tolerance, salt tolerance, resistance to nematode stress, resistance to a fungal pathogen, resistance to a bacterial pathogen, resistance to a viral pathogen, altered metabolite expression, and altered protein expression, relative to reference seeds or agricultural plants derived from reference seeds.

In some embodiments, the contacted seeds are shelf-stable at about 25 degrees C. for at least 6 months.

In other embodiments, the purified bacterial population comprises a plurality of bacterial endophytes from different OTUs.

In additional embodiments, the formulation further comprises one or more of a fungicide, a nematicide or an insecticide.

In some aspects, provided herein is a method for generating a synthetic agricultural preparation, comprising: a) contacting at least one flower of a plurality of agricultural plants with a formulation comprising a purified bacterial population, the bacterial population comprising a bacterial endophyte exhibiting the ability to produce an auxin, an antimicrobial, a siderophore, a cellulase, a chitinase, a xylanase, HCN, NH3, AHL, PHB or acetoin, in an agricultural plant grown from plant seeds produced by the flower.

In other aspects, provided herein is a method of screening a modulator of a plant trait, comprising: (a) applying a library of bacterial entities to a population of flowers of a agricultural plant; (b) measuring a trait in seedlings or plants derived from the seeds produced by the flowers, wherein the trait is selected from the group consisting of root biomass, root length, height, shoot length, leaf number, water use efficiency, overall biomass, yield, increased germination rate, decreased time to start germination, decreased mean germination time, decreased time to 50% germination, decreased time to final germination, increased germination index, increased germination energy, increased coefficient of uniform germination, photosynthesis rate, tolerance to drought, heat tolerance, salt tolerance, resistance to nematode stress, resistance to a fungal pathogen, resistance to a bacterial pathogen, resistance to a viral pathogen, altered levels of a metabolite, and altered protein expression; and (c) identifying at least one of the bacterial entities present in the library capable of modulating the trait, relative to reference seedlings or plants.

In some embodiments, the library comprises at least about 10-100 bacteria of one or more species of bacterial endophytes.

In other aspects, provided herein is a method of identifying a modulator of a plant trait, comprising: (a) applying a bacterial population to flowers of a agricultural plant, the population comprising bacteria of one or more species of bacterial endophytes; (b) measuring a trait in seedlings or plants derived from the seeds made by the flowers, the trait selected from the group consisting of root biomass, root length, height, shoot length, leaf number, water use efficiency, overall biomass, yield, increased germination rate, decreased time to start germination, decreased mean germination time, decreased time to 50% germination, decreased time to final germination, increased germination index, increased germination energy, increased coefficient of uniform germination, photosynthesis rate, tolerance to drought, heat tolerance, salt tolerance, resistance to nematode stress, resistance to a fungal pathogen, resistance to a bacterial pathogen, resistance to a viral pathogen, the level of a metabolite, and proteome expression; and (c) identifying at least one of the traits for which the bacterial population results in a modulation of the trait, relative to reference seedlings or plants.

In some embodiments, the bacterial endophytes comprise a plurality of bacterial endophyte entities.

In further aspects, provided herein is a method of screening for a modulator of a plant trait, the method comprising: (a) applying a single entity from a library of bacterial endophyte entities to at least one flower of a population of agricultural plants; (b) measuring a trait in plants grown from the seeds, the trait selected from the group consisting of: root biomass, root length, height, shoot length, leaf number, water use efficiency, overall biomass, yield, increased germination rate, decreased time to start germination, decreased mean germination time, decreased time to 50% germination, decreased time to final germination, increased germination index, increased germination energy, increased coefficient of uniform germination, photosynthesis rate, tolerance to drought, heat tolerance, salt tolerance, resistance to nematode stress, resistance to a fungal pathogen, resistance to a bacterial pathogen, resistance to a viral pathogen, the level of a metabolite, and proteome expression; (c) repeating steps (a) and (b) with one or more additional bacterial endophyte entities from the library; and (d) identifying at least one of the bacterial endophyte entities as modulating at least one of the traits, relative to a reference seedling or plant.

In some embodiments, the library comprises at least 100 species of bacterial endophytes.

In other embodiments, one or more of the bacterial endophytes are obtained from a plant cultivar different from the cultivar of the population of seeds in step (a).

In some embodiments, the bacterial endophytes are bacterial endophytes are obtained from one or more surface sterilized seeds.

In further aspects, disclosed herein is a method of identifying a modulator of a plant trait, the method comprising: (a) applying a purified bacterial population to flowers of an agricultural plant, the bacterial population comprising bacteria of one or more species of bacterial endophytes; (b) measuring a trait in plants grown from the seeds produced by the flowers, the trait selected from the group consisting of root biomass, root length, height, shoot length, leaf number, water use efficiency, overall biomass, yield, increased germination rate, decreased time to start germination, decreased mean germination time, decreased time to 50% germination, decreased time to final germination, increased germination index, increased germination energy, increased coefficient of uniform germination, photosynthesis rate, tolerance to drought, heat tolerance, salt tolerance, resistance to nematode stress, resistance to a fungal pathogen, resistance to a bacterial pathogen, resistance to a viral pathogen, the level of a metabolite, and proteome expression; and (c) identifying a modulation of at least one of the traits in the plants, relative to reference plants.

In some embodiments, the purified bacterial population comprises 2-6 different bacterial endophytes.

In other embodiments, the one or more bacterial endophytes are obtained from a plant cultivar different from the cultivar of the seeds in (a).

In further embodiments, the bacterial endophytes are obtained from a surface sterilized seed.

In further aspects, disclosed herein is a method for preparing an agricultural seed preparation comprising a microbe localized in the seed, comprising: (a) contacting at least one flower of a plurality of agricultural plants with a formulation comprising a purified bacterial population, the bacterial population comprising a bacterial endophyte exhibiting the ability to induce in a seed made by the flower, a seedling grown from the seed or an agricultural plant grown from the seed an alteration in the population of microbes present in the seed or plant, as compared to a reference seed, seedling or plant.

In some embodiments, the alteration in the population of microbes is an increase in the number of bacteria of the Comamonadaceae or Xanthomonadaceae families.

In some embodiments, the alteration in the population of microbes is a decrease in the number of bacteria of the Actinomycetaceae, Chitinophagaceae, Phyllobacteriaceae, Microbacteriaceae, Exiguobacteraceae, Sphingomonadaceae, Phyllobacteriaceae, or Enterobacteriaceae families.

In some embodiments, the alteration in the population of microbes is the appearance of at least one microbe that is not present within the reference seed, seedling or plant, in addition to the bacterial endophyte.

In other embodiments, the at least one microbe that is not present within the reference seed, seedling or plant is of the Kineosporiaceae, Weeksellaceae, Geodermatophilaceae, Bacillaceae, Thermicanus, Weeksellaceae, or Geodermatophilaceae families.

In other embodiments, the alteration in the population of microbes is the disappearance of at least one microbe that is present within the reference seed, seedling or plant.

In some embodiments, the at least one microbe that is present within the reference seed, seedling or plant is of the Chitinophagaceae or Alcaligenaceae families.

In other embodiments, the bacterial endophyte is present in the formulation in an amount capable of providing a benefit to a seed derived from the flower, to a seedling derived from the seed, or to agricultural plants derived from the seed, as compared to a reference seed, seedling or plant.

In other embodiments, the benefit is selected from the group consisting of: increased root biomass, increased root length, increased height, increased shoot length, increased leaf number, increased water use efficiency, increased overall biomass, increased yield, increased germination rate, decreased time to start germination, decreased mean germination time, decreased time to 50% germination, decreased time to final germination, increased germination index, increased germination energy, increased coefficient of uniform germination, photosynthesis rate, tolerance to drought, heat tolerance, salt tolerance, resistance to nematode stress, resistance to a fungal pathogen, resistance to a bacterial pathogen, resistance to a viral pathogen, altered metabolite expression, and altered protein expression, relative to reference seeds or agricultural plants derived from the reference seeds.

In other embodiments, the benefit comprises at least two benefits selected from the group consisting of: increased root biomass, increased root length, increased height, increased shoot length, increased leaf number, increased water use efficiency, increased overall biomass, increased yield, increased germination rate, decreased time to start germination, decreased mean germination time, decreased time to 50% germination, decreased time to final germination, increased germination index, increased germination energy, increased coefficient of uniform germination, photosynthesis rate, tolerance to drought, heat tolerance, salt tolerance, resistance to nematode stress, resistance to a fungal pathogen, resistance to a bacterial pathogen, resistance to a viral pathogen, altered metabolite expression, and altered protein expression, relative to reference seeds or agricultural plants derived from reference seeds.

In further aspects, disclosed herein is a method for preparing an agricultural seed preparation comprising a microbe localized in the seed, comprising: (a) contacting at least one flower of a plurality of agricultural plants with a formulation comprising a purified bacterial population, the bacterial population comprising a bacterial endophyte exhibiting the ability to induce in a seed made by the flower, a seedling grown from the seed or an agricultural plant grown from the seed an alteration in the level of expression of at least one protein, as compared to a reference seed, seedling or plant.

In other embodiments, the bacterial endophyte is present in the synthetic combination in an amount effective to increase the level of at least one protein involved in resistance against abiotic stress within the seed, a seedling derived from the seed or a cereal agricultural plant derived from the seed, as compared to a reference seed, seedling or plant.

In other embodiments, the protein involved in resistance against abiotic stress is a protein selected from those involved in response to heavy metals, proteins associated with ion transport and proteins involved in salt stress and water stress tolerance.

In some embodiments, the protein is a ribosomal protein.

In other embodiments, the bacterial endophyte is present in the synthetic combination in an amount effective to increase the level of at least one protein involved in symbiosis within the seed, a seedling derived from the seed or a cereal agricultural plant derived from the seed, as compared to a reference seed, seedling or plant.

In further embodiments, the protein involved in symbiosis is involved in a protein involved in the defense or establishment of symbiosis with microbes.

In other embodiments, the protein is involved in pathogen response, ribosomal protein, protein homologous to those involved in nodule formation in legumes, and protein associated with micorrhiza.

In some other embodiments, the bacterial endophyte is present in the synthetic combination in an amount effective to increase the level of at least one protein involved in growth promotion within the seed, a seedling derived from the seed or a cereal agricultural plant derived from the seed, as compared to a reference seed, seedling or plant.

In other embodiments, the protein involved in growth promotion is selected from the group consisting of elongation factors, proteins related to nutrient acquisition and proteins involved in chromosomal segregation during mitosis.

In additional embodiments, the formulation further comprises a carrier and a surfactant.

In some embodiments, the surfactant is Silwet™ L-77.

In some embodiments, the carrier is a zeolite.

In further aspects, disclosed herein is a synthetic combination of a purified bacterial population in association with a seed of an agricultural plant, wherein the synthetic combination is produced by the steps of (a) contacting at least one flower of a plurality of agricultural plants with a formulation comprising a purified bacterial population, the bacterial population comprising a bacterial endophyte exhibiting the ability to produce or induce in a seed made by the flower, a seedling grown from the seed or an agricultural plant grown from the seed an activity selected from catalase activity, oxidase activity, casein hydrolysis activity, gelatin hydrolysis activity, ACC-deaminase activity, exopolysaccharide activity, amylase activity, cellulase activity, chitinase activity, hemolytic activity, lipase activity, pectinase activity, phosphatase activity, protease activity, xylanase activity, production of an auxin, production of an antimicrobial, production of HCN, production of NH3, production of AHL, production of PHB, production of a siderophore, mineral phosphate solubilization, and production of acetoin, wherein the bacterial endophyte is present in the formulation in an amount capable of providing a benefit to the seeds or to agricultural plants derived from the seeds, as compared to a reference seed, seedling or plant and (b) harvesting the seed.

In some embodiments of the synthetic combination, the bacterial endophytes comprise a plurality of bacterial endophyte entities.

In some embodiments, the synthetic combination is disposed within a packaging material selected from a bag, box, bin, envelope, carton, or container.

In some embodiments, the synthetic combination comprises 1000 seed weight amount of seeds, wherein the packaging material optionally comprises a dessicant, and wherein the synthetic combination optionally comprises an anti-fungal agent.

In some embodiments of the synthetic combination, the bacterial population comprises a first bacterial endophyte having a first 16S nucleic acid sequence and a second bacterial endophyte having a second 16S nucleic acid sequence, wherein the first and the second 16S nucleic acid sequences are less than 97% identical.

In further aspects, disclosed herein is an agricultural product comprising a 1000 seed weight amount of a synthetic combination produced by the step of contacting at least one flower from a plurality of agricultural plants with a liquid formulation comprising a bacterial population, under conditions such that the formulation is associated with the flowers in a manner effective for the bacterial endophytes to confer a benefit to the seeds produced from the flowers or to a crop comprising a plurality of agricultural plants produced from the seeds.

In some embodiments of the synthetic combination, the bacterial endophyte is a bacterial endophyte.

In some embodiments, the synthetic combination is disposed within a packaging material selected from a bag, box, bin, envelope, carton, or container.

In some embodiments, the synthetic combination comprises 1000 seed weight amount of seeds, wherein the packaging material optionally further comprises a dessicant, and wherein the synthetic combination optionally further comprises an anti-fungal agent.

In some embodiments of the synthetic combination, the purified bacterial population comprises a first bacterial endophyte having a first 16S nucleic acid sequence and a second bacterial endophyte having a second 16S nucleic acid sequence, wherein the first and the second 16S nucleic acid sequences are less than 97% identical.

In further aspects, disclosed herein is an agricultural plant comprising the synthetic combination of any of the preceding aspects and embodiments, its tissue, portion or progeny thereof.

In additional aspects, disclosed herein is a commodity product i) comprising the synthetic combination of any of the preceding claims, its tissue, portion or progeny thereof, or ii) isolated from a plant grown or derived from the synthetic combination of any of the preceding claims, its tissue, portion or progeny thereof.

In other aspects, disclosed herein is an agricultural field comprising a population of plants derived from the synthetic combination of any of the preceding claims, its tissue, portion or progeny thereof.

In some embodiments of the agricultural field at least about 90% of the population has a plant height or germination variation not exceeding 1%<2%, 3%, 4%, 5%, 10%, 15%, 20% or 25%.

In an embodiment, provided herein is a grain product obtained from the agricultural field above.

In other aspects, disclosed herein is method for generating an agricultural seed preparation, comprising: (a) isolating a bacterial endophyte derived from a plant living in a habitat of biotic or abiotic stress; b) contacting at least one flower of a plurality of agricultural plants from a different habitat with a synthetic formulation comprising a purified bacterial population, the bacterial population comprising the isolated bacterial endophyte in an amount effective to colonize the at least one seed made by the flower, wherein the bacterial endophyte exhibits the ability to produce or induce in the at least one seed made by the flower, or in a seedling or an agricultural plant grown from the at least one seed, a functional activity selected from at least two of: catalase activity, oxidase activity, casein hydrolysis activity, gelatin hydrolysis activity, ACC-deaminase activity, exopolysaccharide activity, amylase activity, cellulase activity, chitinase activity, hemolytic activity, lipase activity, pectinase activity, phosphatase activity, protease activity, xylanase activity, production of an auxin, production of an antimicrobial, production of HCN, production of NH3, production of AHL, production of PHB, production of a siderophore, mineral phosphate solubilization, and production of acetoin.

In some embodiments, the method further comprises the step of selecting from the population of isolated agricultural seeds a sub-population having increased uniformity relative to the population. In some embodiments, the isolated population of agricultural seeds comprises increased uniformity relative to a population of agricultural seeds isolated from reference agricultural plant. In some embodiments, the population of isolated agricultural seeds comprises increased uniformity with every repetition of the method. In some embodiments, the isolated population displays increased uniformity of the distribution of the isolated microbe on and/or in the agricultural seed and/or an agricultural plant derived from the agricultural seed. In some embodiments, the isolated population displays increased uniformity of the reduction of native endophytes on and/or in the agricultural seed. In some embodiments, the isolated population displays increased uniformity of the reduction of one or more native microbes on and/or in the agricultural seed. In some embodiments, the isolated population displays increased uniformity of the reduction of one or more microbes other than the isolated microbe on and/or in the agricultural seed. In some embodiments, the isolated population displays increased uniformity of one or more microbe networks on and/or in the agricultural seed. In some embodiments, the isolated population displays increased uniformity of the genetic similarity of the microbes on and/or in the agricultural seed. In some embodiments, the isolated population displays increased uniformity of the presence and/or activity of one or more viral entities on and/or in the agricultural seed. In some embodiments, the isolated population displays increased uniformity of the metabolomics signature of one or more microbes on and/or in the agricultural seed. In some embodiments, the isolated population displays increased uniformity of the presence of one or more microbes other than the isolated microbe on and/or in the agricultural seed. In some embodiments, the isolated population displays increased uniformity of the non-genomic nucleic acid content of one or more microbes on and/or in the agricultural seed. In some embodiments, the nucleic acid content comprises a plasmid, an episome, RNA, DNA, or a viral nucleic acid. In some embodiments, the method comprises a validating step that comprises causing the agricultural seeds in the isolated population to germinate and grow into mature agricultural plants and selecting one or more validated agricultural plants having increased uniformity, and the agricultural seeds thereof. In some embodiments, the method further comprises the step of preparing the agricultural seed or population thereof for use in agriculture.

In some embodiments, the inoculant microbe is located in the seed coat, endosperm, cotyledons, or embryo of the seed. In some embodiments, the microbe is viably and stably incorporated into the seed. In some embodiments, the method further comprises the step of reducing endogenous microbes in the agricultural plant prior to contacting with the microbe preparation. In some embodiments, the agricultural plant is substantially gnotobiotic prior to contacting with the microbe preparation. In some embodiments, the parts of the agricultural plant contacted with the microbe preparation are substantially free of endogenous microbes. In some embodiments, the agricultural plant is cured of endogenous microbes prior to the contacting step. In some embodiments, the method further comprises the step of contacting the agricultural plant with a second microbe preparation. In some embodiments, the agricultural plant is a monocotyledonous plant. In some embodiments, the agricultural plant is a cereal plant. In certain embodiments, the agricultural plant is one or more monocotyledonous plants selected from the group consisting of *Hordeum vulgare, Zea mays, Triticum* sp., subspecies thereof, cultivars thereof, and variants thereof. In some embodiments, the agricultural plant is a dicotyledonous plant. In certain embodiments, the agricultural plant is one or more dicotyledonous plants selected from the group consisting of *Glycine max, Gossypium* sp., subspecies thereof, cultivars thereof, and variants thereof.

In some embodiments, the inoculant microbe is isolated from a source selected from the group consisting of soil extract, plant extract, including sap extract, fruit extract, root extract, root exudate, seed extract and flower extract. In some embodiments, the microbe is isolated from a stress adapted plant or a plant present in an environment susceptible to an agricultural stress. In some embodiments, the microbe is isolated from the same plant species as the plant being treated, and the treatment results in an increased level of the microbe in the seed made by the flower or the plant grown from the seed, as compared to a reference seed or reference plant. In some embodiments, the microbe is isolated from a different plant species as the plant being treated, and the treatment results in the appearance of a new microbe in the seed made by the flower or the plant grown from the seed. In some embodiments, the inoculant microbe is capable of specifically localizing in a tissue of an endoseed or an agricultural seedling or plant derived from the endoseed. In some embodiments, the inoculant microbe is capable of localizing in the embryo of the seed, in the roots of the seedling or plant, and/or in the shoots of the seedling or plant. In some embodiments, the inoculant microbe is capable of recruiting microbes into the seed made by the flower or the plant grown from the seed, such that in addition to the appearance or increase in levels of the inoculant microbe, the seed or the plant also newly contains a microbe that was undetectable before the treatment.

In some embodiments, is provided a method in which the flowers of a genetically modified plant are contacted with the formulation.

In some embodiments, the microbe preparation comprises a suspension of microbes at a concentration of at least $10^2$ CFU/mL, at least $10^3$ CFU/mL, at least $10^4$ CFU/mL, at least $3\times10^4$ CFU/mL, at least $10^5$ CFU/mL, at least $3\times10^5$ CFU/mL, at least $10^6$ CFU/mL, at least $3\times10^6$ CFU/mL, at least $10^7$, at least $3\times10^7$ CFU/mL, at least $10^8$ CFU/mL or more. In some embodiments, the inoculant microbe is present in the agricultural seed, or any agricultural plant derived therefrom, at a higher level than any other microbe present in the agricultural seed or any agricultural plant derived therefrom. In some embodiments, the inoculant microbe is present in the isolated agricultural seed, or any agricultural plant derived therefrom, at a higher copy number than any other microbe present in the isolated agricultural seed or any agricultural plant derived therefrom. In some embodiments, the inoculant microbe is present in the agricultural seed, or any agricultural plant derived therefrom, at a higher level than the inoculant microbe is natively present in an agricultural seed or any agricultural plant derived therefrom. In some embodiments, the inoculant microbe is present in the agricultural seed, or any agricultural plant derived therefrom, at a higher level in a specific tissue than the inoculant microbe is natively present in the specific tissue in an agricultural seed or any agricultural plant derived therefrom. In some embodiments, the inoculant microbe is present in the agricultural seed, or any agricultural plant derived therefrom, at a higher level than any other microbe present in the agricultural seed or any agricultural plant derived therefrom. In some embodiments, the inoculant microbe is present in the agricultural seed, or any agricultural plant derived therefrom, at a higher copy number than any other microbe present in the agricultural seed or any agricultural plant derived therefrom. In some embodiments, the inoculant microbe is present in the agricultural seed, or any agricultural plant derived therefrom, at a higher level than the inoculant microbe is natively present in an agricultural seed or the environment thereof, or any agricultural plant derived therefrom. In some embodiments, the inoculant microbe is present in the agricultural seed, or any agricultural plant derived therefrom, at a higher level in a specific tissue than the isolated microbe is natively present in the specific tissue in an agricultural seed or any agricultural plant derived therefrom.

In some embodiments, the microbe preparation comprises a microbe selected from Tables 1-5 or 16. In some embodiments, the microbe preparation comprises a microbe having a 16S, 18S or ITS rRNA sequence at least 97% identical to SEQ ID NO: 1-160. In some embodiments, the microbe preparation comprises a microbe capable of functionally interacting with a microbe selected from Tables 1-5 or 16. In some embodiments, the seed is produced by the methods described herein. In some embodiments, upon germination of the endoseed into a vegetative state, the microbe is localized or capable of localizing to another tissue of the plant. In some embodiments, the microbe is localized or capable of localizing to any one of the tissues selected from the group consisting of the root, adventitious root, seminal root, root hair, shoot, leaf, flower, bud, tassel, meristem, pollen, pistil, ovaries, stamen, fruit, stolon, rhizome, nodule, tuber, trichome, guard cells, hydathode, petal, sepal, glume, rachis, vascular cambium, phloem, and xylem. In some embodiments, the microbe is intercellularly located. In some embodiments, the microbe is intracellularly located in a plant cell. In some embodiments, the microbe is intracellularly located in a fungal cell present in or associated with the agricultural plant.

In some embodiments, the inoculant microbe is a fungus. In some embodiments, the fungus is resistant to or not perturbed by any one of the compounds selected from Table 9 or Table 10. In some embodiments, the microbe is a bacterium. In some embodiments, the bacterium is a gram-negative bacterium. In some embodiments, the bacterium is a gram-positive bacterium. In some embodiments, the microbe is resistant to or not perturbed by any one of the compounds selected from Tables 9-14. In some embodiments, the microbe is selected from Tables 1 to 5 or 16. In some embodiments, the microbe is not an *Agrobacterium*. In some embodiments, the microbe is not capable of nitrogen fixation. In some embodiments, the microbe is not from the genus *Acetobacter*. In some embodiments, the microbe is not from the genus *Bacillus*. In some embodiments, the microbe is not *Bacillus mojavensis*. In some embodiments, the microbe is not from the genus *Bacillus*. In some embodiments, the microbe is not from the genus *Neotyphodium*. In some embodiments, the microbe is not from the genus *Rhizobium*.

In some embodiments, the inoculant microbe is present at a concentration of at least 5 CFU/seed, for example at least 10 CFU/seed, at least 30 CFU/seed, at least 100 CFU/seed, at least 300 CFU/seed, at least 1000 CFU/seed, at least 3,000 CFU/seed, at least 10,000 CFU/seed. In some embodiments, the microbe represents at least 0.1%, 0.5%, 1%, 2%, 3%, 4%, 5%, 10% of the total microbe population, for example at least 20%, at least 30%, at least 40%, at least 50%, at least 60%, at least 70%, at least 80%, at least 90%, at least 95%, at least 99%, or 100% of the total microbe population in and/or on the seed. In some embodiments, the seed further comprises a second microbe that is heterologous to the agricultural plant and wherein the second microbe is located inside the seed.

In another aspect, provided is an agricultural plant grown from the seed made by the flower, as described herein. In another aspect, provided is a material derived from the agricultural plant described herein. In some embodiments, the material is selected from the group consisting of a seed, root, fruit, grain, tuber, shoot, stem, flower, cutting, and leaf. In some embodiments, the material comprises the microbes with at least 10 CFU, at least 100 CFU, at least 300 CFU, at least 1000 CFU, at least 3000 CFU or more, of the microbe.

In another aspect, provided are methods of producing a commodity plant product, comprising obtaining the plant described herein or a tissue thereof and producing the commodity plant product therefrom. In some embodiments, the commodity plant product is selected from the group consisting of grain, flour, starch, seed oil, syrup, meal, flour, oil, film, packaging, nutraceutical product and protein.

In another aspect, provided is a stabilized formulation for the inoculation of an agricultural plant, comprising at least 10 CFU/mL of an heterologous microbe from a stress adapted plant in an agriculturally acceptable carrier.

In another aspect, provided is a substantially uniform population of plants produced by growing a plurality of seeds produced by the method described herein. In some embodiments, in the population, at least 75%, at least 80%, at least 90%, at least 95% or more of the plants comprise in one or more tissues an effective amount of the microbes. In some embodiments, in the population, at least 10%, 20%, 30%, 40%, 50%, 60%, 70%, 75%, at least 80%, at least 90%, at least 95% or more of the plants comprise a microbe population that is substantially similar.

In another aspect, provided is an agricultural field comprising the population described herein.

In some embodiments, the field comprises at least 100 plants. In some embodiments, the field comprises a population wherein the population occupies at least about 100 square feet of space, wherein at least about 10%, 20%, 30%, 40%, 50%, 60%, 70%, 80%, 90% or more than 90% of the population comprises an effective amount of the microbe. In some embodiments, the field comprises a population wherein the population occupies at least about 100 square feet of space, wherein at least about 10%, 20%, 30%, 40%, 50%, 60%, 70%, 80%, 90% or more than 90% of the population comprises the microbe in reproductive tissue. In some embodiments, the field comprises a population wherein the population occupies at least about 100 square feet of space, wherein at least about 10%, 20%, 30%, 40%, 50%, 60%, 70%, 80%, 90% or more than 90% of the population comprises at least 10 CFUs, 100 CFUs, 1,000 CFUs, 10,000 CFUs or more of the microbe. In some embodiments, the field comprises a population wherein the population occupies at least about 100 square feet of space, wherein at least about 10%, 20%, 30%, 40%, 50%, 60%, 70%, 80%, 90% or more than 90% of the population comprises a heterologous microbe of monoclonal origin. In some embodiments, the field comprises a population wherein the population occupies at least about 100 square feet of space, wherein at least about 10%, 20%, 30%, 40%, 50%, 60%, 70%, 80%, 90% or more than 90% of the population comprises an effective amount of a heterologous microbe at least 97% identical at the 16S, 18S or ITS rRNA to another heterologous microbe in the population.

In another aspect, provided are methods for the agricultural production of a uniform population of agricultural seeds, the method comprising:
a. planting a plurality of seeds produced by the method described herein;
b. causing the seeds to be germinated;
c. causing the germinated seeds to grow into mature agricultural plants; and
d. collecting seeds from the mature agricultural plants.

In some embodiments, the method further comprises repeating the steps one or more times, wherein a plurality of the seeds collected in step d. are planted in step a. In some embodiments, at least 75%, at least 80%, at least 90%, at least 95% or more of the collected seeds comprise an effective amount of the microbe. In some embodiments, at least 10%, 20%, 30%, 40%, 50%, 60%, 70%, 75%, at least 80%, at least 90%, at least 95% or more of the collected seeds comprise a substantially similar microbe population. In some embodiments, the method further comprises coating the collected seeds with a composition comprising an agent selected from the group consisting of a control agent, a plant growth regulator, a fertilizer and a nutrient. In some embodiments, the method further comprises contacting the agricultural plants with a synthetic preparation of the microbes.

DESCRIPTION OF THE FIGURES

FIG. 1 shows maize seeds and compositions that have been introduced with a desired hormone-producing, phosphate-solubilizing gram-negative bacteria. Specifically, the cob sheath, grain and cob interior show colonization of the proteobacteria *Burkholderia phytofirmans* strain PsJN in maize cvs Peso and Morignon (x-axis shows CFU/g dry weight).

FIG. 2 shows light microscopy images of a mature seed colonized by a desired hormone-producing, phosphate-solubilizing gram-negative proteobacteria. Specifically, *Burkholderia phytofirmans* strain PsJN is engineered with gusA in order to allow its detection with a colorimetric assay. The blue color is due to gusA-marked bacterial cells; strain PsJN is present inside the embryo (a, b) and in radicals (c); PsJN starts moving from embryo to germinated parts (c);

FIG. 3 shows the recovery of a desired hormone-producing, phosphate-solubilizing gram-negative proteobacteria (*Burkholderia phytofirmans* strain PsJN) from the grain interior at different time intervals after harvesting (DAH; Days after harvesting) and storage at room temperature;

FIG. 4 shows the ability of maize seeds that were generated to comprise the hormone-producing, phosphate-solubilizing gram-negative proteobacteria (*Burkholderia phytofirmans* strain PsJN) to germinate after prolonged storage at room temperature, allowing the further propagation of the microbe (a, b, c)

DETAILED DESCRIPTION

Definitions

Figures 5, 5A, 5B, 5C:
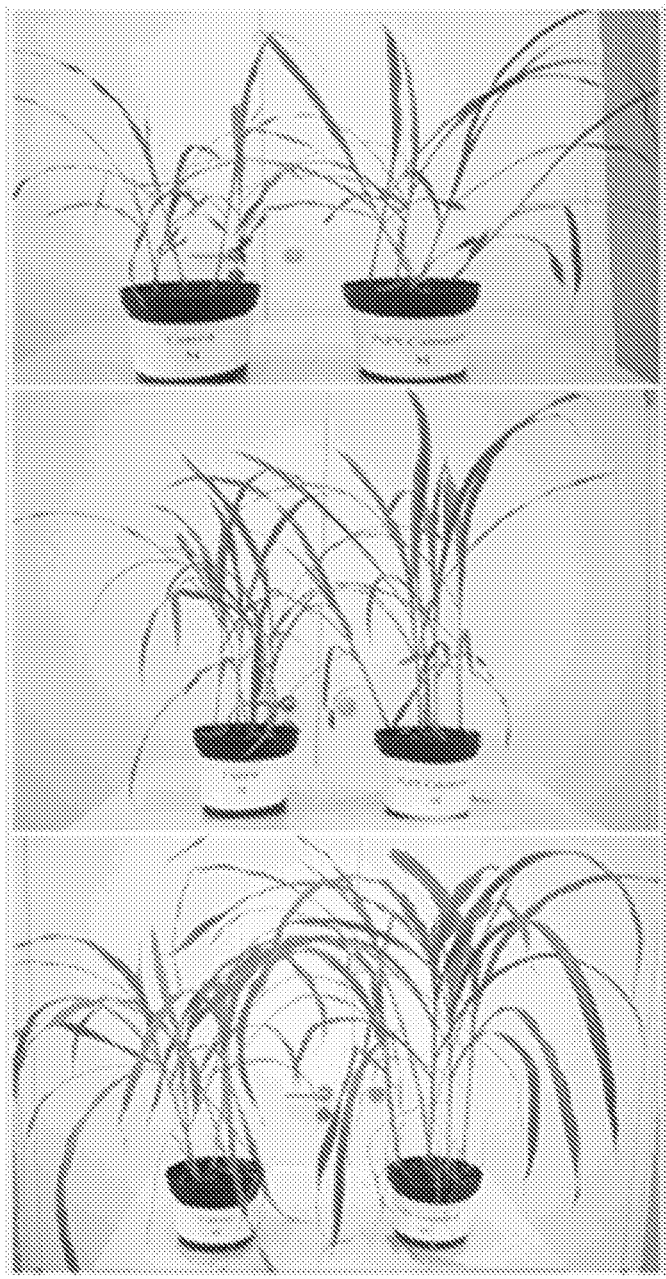
FIG. 5 shows the ability of a desired hormone-producing, phosphate-solubilizing gram-negative proteobacteria (*Burkholderia phytofirmans* strain PsJN) to propagate following germination of maize seeds comprising the microbe that were stored at room temperature for long periods of time (a, b, c; 30, 45, 60 days after sowing).

The term "endophyte" refers to—in its broadest meaning—the location of an organism, with "endo" means "inside" and "phyte" means "plants". An "endophyte" or "endophytic microbe" is an organism that lives within a plant or is otherwise associated therewith. Endophytes can occupy the intracellular or extracellular spaces of plant tissue, including the leaves, stems, flowers, fruits, seeds, or roots. An endophyte can be either a bacterial or a fungal organism that can confer a beneficial property to a plant such as an increase in yield, biomass, resistance, or fitness in its host plant. As used herein, the term "microbe" is sometimes used to describe an endophyte.

The term "endosphere" refers to—in its broadest meaning—the collection of microorganisms residing at least partially inside of the tissues of a plant.

As used herein, the term "microbe" refers to a microorganism of bacterial or fungal origin. Therefore, the terms microbe and microorganism can be used interchangeably. As used herein, in certain embodiments, a microbe may be an endophyte. In other embodiments, a microbe may not be an endophyte.

As used herein, the term "inoculant microbe" is the microbe that is used to contact the flower of an agricultural plant.

As used herein, the term "endoseed" refers to the agricultural seed produced by the flower of an agricultural plant that was contacted with an inoculant microbe.

In some embodiments, the invention uses microbes (e.g., endophytes) that are heterologous to a seed or plant in making synthetic combinations or agricultural formulations. A microbe is considered "heterologous" to the seed or plant if the seed or seedling that is unmodified (e.g., a seed or seedling that is not treated with an endophyte population described herein, or which is derived from a parent plant that was not treated with an endophyte population described herein) does not contain detectable levels of the microbe or contains diminished levels of the microbe. For example, the invention contemplates the synthetic combinations of seeds or seedlings of agricultural plants (e.g., *Glycine* plants or agricultural grass plants) and an endophytic microbe population (e.g., endophyte), in which the microbe population is "heterologously disposed" on the exterior surface of or within a tissue of the agricultural seed or seedling in an amount effective to colonize the plant. A microbe is considered "heterologously disposed" on the surface or within a plant (or tissue) when the microbe is applied or disposed on or in the plant in a number that is not found on that plant before application of the microbe. For example, a bacterial endophytic population that is disposed on an exterior surface or within the seed can be an endophytic bacterium that may be associated with the mature plant, but is not found on the surface of or within the seed. As such, a microbe is deemed heterologously disposed when applied on the plant that either does not naturally have the microbe on its surface or within the particular tissue to which the microbe is disposed, or does not naturally have the microbe on its surface or within the particular tissue in the number that is being applied. Indeed, several of the endophytic microbes described herein have not been detected, for example, in any of the seeds sampled, as determined by highly sensitive methods. Additional microbes have not been detected in the abundance described herein, within the specific intercellular regions within seeds as described herein, or with the genetic uniformity across the seed's native population of endophytes as described herein.

In contrast, a microbe is considered "endogenous" to a seed or plant. As used herein, a microbe is considered "endogenous" to a plant or seed, if the microbe is derived from, or is otherwise found in, the seed or the plant, or any plant or seed of the same species.

In contrast, a microbe is considered to be "native" to a plant or a portion of the plant, and is said to be "natively" present in the plant or a portion of plant, if that plant or portion of the plant contains the microbe, for example, in the absence of any contacting with the microbe preparation.

The term "abiotic stress" is used in a very general sense to comprise several kinds of stress that result from, for example, adverse environmental conditions to which the plant is not adapted such as high salt, high or low temperature or drought conditions. Such occurrences result in reduced growth and various kinds of cell damage including death. Abiotic stresses are contrasted with biotic stresses, even though the physiological effects may be very similar.

As used herein, the term "biotic stress" refers to the type of stress that occurs as a result of a living organism such as bacteria, viruses, fungi, parasites, insects (including nematodes), or animals (such as rodents or birds) damaging or hindering the performance of the plant host.

A "genetically modified plant" refers to a plant that contains genetic material not found in a wild-type plant of the same species, variety or cultivar and where the foreign genetic material has been constructed in the laboratory and been introduced using means other than genetic fertilization by pollen. The inserted genetic material usually comprising transgenes can be any DNA sequence and inserted into the host genome at random, or at specific locations by, for example, homologous recombination. Foreign DNA sequences can also be inserted into cells by transfer from one species into another following by chimeraplasty.

A "trait" refers to a physiological, morphological, biochemical, or physical characteristic of a plant or particular plant material or cell. In some instances, this characteristic is visible to the human eye, such as seed or plant size, or can be measured by biochemical techniques, such as detecting the protein, starch, or oil content of seed or leaves, or by observation of a metabolic or physiological process, e.g., by measuring tolerance to water deprivation or particular salt or sugar concentrations, or by the observation of the expression level of a gene or genes, e.g., by employing Northern analysis, RT-PCR, microarray gene expression assays, or reporter gene expression systems, or by agricultural observations such as osmotic stress tolerance or yield. However, any technique known in the art can be used to measure the amount of, comparative level of, or difference in any selected chemical compound or macromolecule in the plants.

As used herein, the term "variety" refers to a group of plants within a species that share constant characteristics that separate them from the typical form and from other possible varieties within that species.

As used herein, an "agricultural seed" is a seed used to grow a plant typically used in agriculture (an "agricultural plant"). The seed may be of a monocot or dicot plant, and may be planted for the production of an agricultural product, for example grain, food, fiber, etc. As used herein, an agricultural seed is a seed that is prepared for planting, for example, in farms for growing.

As used herein, a "reference seed" is an agricultural seed of the same species, strain, or cultivar to which a treatment, formulation, composition, purified bacterial population, or a seed derived from parental plants that were not contacted with a treatment or endophyte/microbe preparation. A reference seed, therefore, is identical to the treated seed with the exception of the presence of the inoculated endophyte and can serve as a control for detecting the effects of the inoculated endophyte that is conferred to the seed.

As used herein, the term "mother plant" or "parental" refers to a plant that contributed genetic material to the generation of a seed, or a plant that produced a seed or a lineage of seeds. A mother plant or parental plant can refer to a plant that produced seed that resulted in multiple generations of progeny plants, wherein the ancestry of the progeny plants can be traced back to the parental or mother plant. In certain embodiments, a mother plant or parental plant is inoculated to produce a seed product harboring a novel endophyte. In certain embodiments, a mother plant or parental plant is inoculated in order to produce seeds that are further passaged to produce multiple generations of progeny seeds that comprise the novel endophyte.

An "agricultural plant" can be a monocotyledonous (i.e., an "agricultural grass plant") or a dicotyledonous plant (e.g., a *Glycine* plant such as *Glycine max*) typically used in agriculture. An agricultural grass plant includes, but is not limited to, maize (*Zea mays*), common wheat (*Triticum aestivum*), spelt (*Triticum spelta*), einkorn wheat (*Triticum monococcum*), emmer wheat (*Triticum dicoccum*), durum wheat (*Triticum durum*), Asian rice (*Oryza sativa*), African rice (*Oryza glabaerreima*), wild rice (*Zizania aquatica, Zizania latifolia, Zizania palustris, Zizania texana*), barley (*Hordeum vulgare*), Sorghum (*Sorghum bicolor*), Finger millet (*Eleusine coracana*), Proso millet (*Panicum miliaceum*), Pearl millet (*Pennisetum glaucum*), Foxtail millet (*Setaria italic*), Oat (*Avena sativa*), Triticale (*Triticosecale*), rye (*Secale cereal*), Russian wild rye (*Psathyrostachys juncea*), bamboo (*Bambuseae*), or sugarcane (e.g., *Saccharum arundinaceum, Saccharum barberi, Saccharum bengalense, Saccharum edule, Saccharum munja, Saccharum officinarum, Saccharum procerum, Saccharum ravennae, Saccharum robustum, Saccharum sinense*, or *Saccharum spontaneum*).

As used herein, a "reference agricultural plant" is an agricultural plant of the same species, strain, or cultivar to which a treatment or endophyte/microbe preparation is not administered/contacted or a plant derived from parental plants that were not contacted with a treatment or endophyte/microbe preparation. A reference agricultural plant, therefore, is identical to the microbe-associated plant with the exception of the presence of the microbe, and can serve as a control for detecting the effects of the microbe that is conferred to the plant.

A "host plant" includes any plant, particularly an agricultural plant, which an endophytic microbe can colonize.

Some of the methods described herein allow the colonization of plant seeds by microbes. As used herein, a microbe is said to "colonize" a plant or seed when it can exist in a symbiotic or non-detrimental relationship with the plant in the plant environment, for example on and/or inside a plant, including the seed.

A "population" of plants, as used herein, can refer to a plurality of plants that were subjected to the same inoculation methods described herein, or a plurality of plants that are progeny of a plant or group of plants that were subjected to the inoculation methods. In addition, a population of plants can be a group of plants that are grown from coated seeds. The plants within a population will typically be of the same species, and will also typically share a common genetic derivation.

The present invention contemplates the use of "isolated" microbes. As used herein, an isolated microbe is a microbe that is isolated from its native environment, and carries with it an inference that the isolation was carried out by the hand of man. An isolated microbe is one that has been separated from at least some of the components with which it was previously associated (whether in nature or in an experimental setting).

As used herein, the term "non-genomic nucleic acid content" refers to the content of non-chromosomal nucleic acids, and includes viral-encoded, plasmid-borne, episomal-borne nucleic acids, as well as signaling and regulatory RNA molecules, including microRNA, dsRNA, and related RNA molecules.

As used herein, the "reproductive tissue" of a plant includes the tissues involved with reproduction, and includes any part of a flower including, but not limited to, the stamen, pistil, carpel, petal, ovule, ovary, anther, filament, stigma, sepal, receptacle, locule, peduncle, petal, and tassel.

The term "propagate", as used herein, means to grow or cultivate a population of cells.

As used herein, a "portion" of a plant refers to any part of the plant, and can include distinct tissues and/or organs, and is used interchangeably with the term "tissue" throughout.

As used herein, a plant or portion thereof that is "cured", or sterilized of an endogenous microbe is one in which substantially all, or all of the endogenous microbes that reside within the plant or portion thereof is removed.

As used herein, a plant is deemed "intact" if the plant has not been physically compromised in any way, for example, by cutting, puncturing, or otherwise piercing the surface in a way that allows direct access to the internal portions of the plant.

As used herein, the term "progeny", in the context of describing a plant, denotes the offspring of any generation of a parent plant. Progeny of a plant, therefore, refers to generations of a plant, wherein the ancestry of the generation can be traced back to the plant. Likewise, the "progeny" of a microbe refers to the offspring of any generation of the microbe.

Microbes are deemed to be of "monoclonal origin" if the microbes are progeny of a common microbe.

As used herein, a "purified" seed population refers to a selected group of seeds from a larger population, based on a given set of criteria.

As used herein, there is a "reduction" of one or more native microbes when a microbe, for example a microbe that inoculates a plant, partially or completely displaces of one or more species of native populations of endophytes. In other words, the inoculation with one microbe results in the reduction or loss of one or more native microbes in a plant or portion thereof.

In some embodiments, an agriculturally compatible carrier or agriculturally acceptable carrier can be used to formulate an agricultural formulation or other composition that includes a purified bacterial preparation. As used herein an "agriculturally compatible carrier" or "agriculturally acceptable carrier" refers to any material, other than water, which can be added to a seed or a seedling without causing or having an adverse effect on the seed (e.g., reducing seed germination) or the plant that grows from the seed, or the like.

As used herein, a microbe-associated plant or portion thereof is said to have an "altered chemical composition" when there is a detectable change in the chemical composition of such plant or portion thereof, when compared with a corresponding plant or portion thereof that is not associated with the microbe and grown and/or subjected to the same conditions.

In some embodiments, the present invention contemplates the use of a "community" of microbes. As used herein, a community of microbes refers to a plurality of distinct microbes. In some cases, the distinct microbes can be different species. In other cases, the community of microbes can be the same species but with distinct functions.

As used herein, a "productivity" of an agricultural plant refers to the production of the plant, or a desirable, or commercial portion thereof. Therefore, an increase in productivity of a plant, for example, can refer to an increase in fruit or grain yield. It can also refer to an overall increase in total biomass, or the portion that is harvested and used in commerce.

As used herein, a microbe is deemed to be "viably incorporated" into a seed if it is located in the seed, and remains viable through desiccation.

Likewise, as used herein, a microbe is "stably incorporated" into a seed, if the microbe is capable of persisting in the plant after germination of the seed, and microbe or progeny of the microbe, is capable of colonizing the seeds from the plant.

As used herein, a seed has a "heritably altered trait" if the seed, or the plant or a portion of the plant that grows from the seed, has a detectably altered trait, and wherein the alteration of the trait can be detected in at least the subsequent generation. As used herein, a seed need not have undergone modification to the sequence of its DNA in order to have a heritably altered trait; the detectably altered trait may arise from the persistence of a microbe to the next generation.

The term "uniformity of the distribution", as used herein, is a measure of the uniformity of a population, for example, of seeds, with respect to the presence and/or quantity of microbes. Therefore, a population in which 100% of the seeds in a population of seeds contains a microbe has a higher, or increased uniformity of seeds when compared with a population in which 70% of the seeds in a population contains the microbe. Likewise, a population in which 80% of the seeds in a population contains at least $10^2$ CFU of a microbe per seed has a higher, or increased uniformity of seeds when compared with a population in which 50% of the seeds in a population contains at least $10^2$ CFU the microbe.

As used herein, the number of microbes of the same kind in a plant or a portion thereof is sometimes referred to as a "copy number". Therefore, a seed is considered to have a higher copy number of a first microbe than another microbe when the first microbe is present in higher numbers than the other microbe within the seed.

The terms "decreased" and "increased" "enhanced" or "greater" as used herein refers to a decrease or increase in a characteristic of the microbe, the seed produced by the flowers treated with the microbe, or the a plant grown from the resulting seed, as compared to an untreated seed or plant. For example, a decrease in a characteristic may be at least 1%, 2%, 3%, 4%, 5%, 10%, 15%, 20%, 25%, 30%, 35%, 40%, 45%, 50%, 75%, 100%, or 200% or more lower than the untreated control and an increase may be at least 1%, 2%, 3%, 4%, 5%, 10%, 15%, 20%, 25%, 30%, 35%, 40%, 45%, 50%, 75%, 100%, or 200% or more higher than the untreated control.

"Biomass" means the total mass or weight (fresh or dry), at a given time, of a plant tissue, plant tissues, an entire plant, or population of plants. Biomass is usually given as weight per unit area. The term may also refer to all the plants or species in the community (community biomass).

In some cases, the present invention contemplates the use of microbes (e.g., endophytes) that are "compatible" with agricultural chemicals, for example, a fungicide, an antibacterial compound, or any other agent widely used in agricultural which has the effect of killing or otherwise interfering with optimal growth of microbes. As used herein, a microbe such as an endophyte is "compatible" with an agricultural chemical when the microbe is modified, such as by genetic modification, e.g., contains a transgene that confers resistance to an herbicide, or is adapted to grow in, or otherwise survive, the concentration of the agricultural chemical used in agriculture. For example, a microbe disposed on the surface of a seed is compatible with the fungicide metalaxyl if it is able to survive the concentrations that are applied on the seed surface.

As used herein, a nucleic acid has "homology" or is "homologous" to a second nucleic acid if the nucleic acid sequence has a similar sequence to the second nucleic acid sequence. The terms "identity," "percent sequence identity" or "identical" in the context of nucleic acid sequences refer to the residues in the two sequences that are the same when aligned for maximum correspondence. There are a number of different algorithms known in the art that can be used to measure nucleotide sequence identity. For instance, polynucleotide sequences can be compared using FASTA, Gap or Bestfit, which are programs in Wisconsin Package Version 10.0, Genetics Computer Group (GCG), Madison, Wis. FASTA provides alignments and percent sequence identity of the regions of the best overlap between the query and search sequences. Pearson, Methods Enzymol. 183:63-98 (1990). The term "substantial homology" or "substantial similarity," when referring to a nucleic acid or fragment thereof, indicates that, when optimally aligned with appropriate nucleotide insertions or deletions with another nucleic acid (or its complementary strand), there is nucleotide sequence identity in at least about 76%, 80%, 85%, or at least about 90%, or at least about 95%, 96%, 97%, 98% 99%, 99.5% or 100% of the nucleotide bases, as measured by any well-known algorithm of sequence identity, such as FASTA, BLAST or Gap, as discussed above.

As used herein, the terms "operational taxon unit," "OTU," "taxon," "hierarchical cluster," and "cluster" are used interchangeably. An operational taxon unit (OTU) refers to a group of one or more organisms that comprises a node in a clustering tree. The level of a cluster is determined by its hierarchical order. In one embodiment, an OTU is a group tentatively assumed to be a valid taxon for purposes of phylogenetic analysis. In another embodiment, an OTU is any of the extant taxonomic units under study. In yet another embodiment, an OTU is given a name and a rank. For example, an OTU can represent a domain, a sub-domain, a kingdom, a sub-kingdom, a phylum, a sub-phylum, a class, a sub-class, an order, a sub-order, a family, a subfamily, a genus, a subgenus, or a species. In some embodiments, OTUs can represent one or more organisms from the kingdoms eubacteria, protista, or fungi at any level of a hierarchal order. In some embodiments, an OTU represents a prokaryotic or fungal order.

As used herein, a "colony-forming unit" ("CFU") is used as a measure of viable microorganisms in a sample. A CFU is an individual viable cell capable of forming on a solid medium a visible colony whose individual cells are derived by cell division from one parental cell.

As used herein the terms "spray" or "spraying" include the technique of applying to an exterior surface an ejected liquid material.

As used herein, a "fungicide" includes a commercially available synthetic chemical compound that is designed to protect crop plants from pathogenic fungi and can have detrimental effects on a beneficial fungal and/or bacterial endophyte's growth and ability to successfully colonize a plant host when that plant host has been treated with the fungicide.

As used herein, a "container" includes a bag or box or other packaging suitable for storing and shipping seeds treated with a formulation that contains beneficial bacterial and/or fungal endophytes. The container may create environmental conditions conducive to the long term stability and viability of the living components of the seed treatment. The container can include a label that consists of information about the treated seed within.

As used herein, a "cultivar" or "plant cultivar" includes a plant whose selection is due to intentional human activity and has characteristics that can be maintained by propagation. In some embodiments, the plant is a landrace or traditional variety, and in other embodiments is a variety that has been developed by plant breeders and registered with the appropriate government entity.

As used herein, the term "microbiome" or "microbiota" refers to the collection of microorganisms of bacterial or fungal origin, and their genetic, biological, and other physical materials that reside within a given habitat. Therefore, the terms microbiome and microbiome can be used interchangeably. As used herein, in certain embodiments, a microbiome may refer to the microbial inhabitants of a plant or a given plant tissue, for example the roots, leaves, or seeds of a plant.

As used herein a "symbiont" or "symbiont strain" refers to a microbe that forms or is in a prolonged physical association with a plant host. In certain embodiments, symbionts or symbiont strains are endophytes.

Plants serve as hosts for diverse microbes in nature and appear to, in some cases, be able to package a very small subset of such microbes into their seeds. We have developed a way to introduce beneficial microbes into plants in such a way that their seeds may get reliably packaged with these novel microbes.

The prevailing view of plant endophytic communities is that they derive predominantly from the soil communities in which plants are grown [Hallman, J., et al., (1997) Canadian Journal of Microbiology. 43(10): 895-914]. Upon observing taxonomic overlap between the endophytic and soil microbiota in *A. thaliana* Dangl and colleagues stated, "Our rigorous definition of an endophytic compartment microbiome should facilitate controlled dissection of plant-microbe interactions derived from complex soil communities" [Lundberg et al., (2012) Nature. 488, 86-90]. Long et al., provide separate support for soil representing the repository from which plant endophytes are derived by writing, "Soil is considered as an endophyte bank . . . " [New Phytologist (2010) 185: 554-567]. Notable plant-microbe interactions such as mycorrhyzal fungi and bacterial *rhizobia* fit the paradigm of soil-based colonization of plant hosts and appear to primarily establish themselves independently of seed.

Less attention has been provided to the role of seeds as reservoirs for microbes that can efficiently populate the plant endosphere. The concept that seeds may harbor plant pathogens was promoted by Baker and Smith [(1966) Annu Rev Phytopathol 14: 311-334] and a few bacterial and fungal pathogens are known to be able to infect seed. When such pathogens are detected in a seed lot, it can necessitate destruction of vast numbers of agricultural germplasm [Gitaitis, R. and Walcott, R. (2007) Annu. Rev. Phytopathol. 45:371-97]. However, even when seed pathogens are detected, their transfer to the growing plant can be highly inefficient. For example, a study of seed-based transmission of the seed pathogen, *Pantoea stewartii*, found that seed produced from a population of pathogen-infected plants gave rise to infected seedlings in only 0.0029% of cases (1 of 34,924 plants) and artificially infected kernels only gave rise to infected seedlings in 0.022% of cases [Block, C. C., el al., (1998). Plant disease. 82(7). 775-780.]. Thus, the efficiency with which plants introduce pathogenic microbes into their seeds, and with which pathogens within seeds propagate within the resulting plant tissues can be very low.

The potential for agricultural seeds to serve as reservoirs for non-pathogenic microbes remains somewhat controversial [Hallman, J., et al., (1997) Canadian Journal of Microbiology. 43(10): 895-914]. Sato, et al., did not detect any bacteria inside rice seeds [(2003) In. Morishima, H. (ed.) The Natural History of Wild Rice—Evolution Ecology of Crop. p. 91-106] and Mundt and Hinkle only obtained endophytes from seed samples where seed coats had been broken or fractured in 29 kinds of plant seed [Appl Environ Microbiol. (1976) 32(5):694-8.]. Another group detected bacterial populations inside rice seeds ranging in population size from $10^2$ to $10^6$ CFU/g fresh weight [Okunishi, S., et al., (2005) Microbes and Environment. 20:168-177]. In crop cultivars such as maize, characterization of pooled seeds from within various cultivars from the genus Zea showed that endophytic taxa appear to be conserved across modern and ancestral variants [Johnston-Monje D, Raizada M N (2011) Conservation and Diversity of Seed Associated Endophytes in Zea across Boundaries of Evolution, Ethnography and Ecology. PLoS ONE 6(6): e20396. doi:10.1371/journal.pone.0020396]. This conservation of seed microbiota across large geographic, ecological, ethnic, and host genetic distances further implies that the seed microbiota is highly resilient to alteration appears to resist the introduction of novel microbes or taxa, even after hundreds of generations of planting of host seeds into novel environments with diverse soil properties, microbial populations, and diverse agricultural chemistries and despite the use of transgenic methods to modify host plant genetic content. This finding is supported by characterization of individual maize seeds (the Raizada et al work characterized pools of ~15 maize seeds at a time) that observed limited overall taxonomic diversity within seeds and additionally described significant variability of the microbial communities within individual maize seeds, including substantial variability between seeds taken from the same cobb (Rosenblueth, M. et al, Seed Bacterial Endophytes: Common Genera, Seed-to-Seed Variability and Their Possible Role in Plants; Proc. XXVIIIth IHC-IS on Envtl., Edaphic & Gen. Factors; Affecting Plants, Seeds and Turfgrass; Eds.: G. E. Welbaum et al. Acta Hort. 938, ISHS 2012). These findings illustrate both that maize seeds appear to contain limited taxonomic diversity and that the microbiota of individual seeds produced by plants can be non-uniform, further implying that it would be challenging to uniformly introduce novel microbes into seeds produced by crops or for such microbes to be subsequently cultivated within the plant's tissue that results from the seed.

Surprisingly, we discovered a variety of methods for efficiently altering the microbiota of seeds produced by crops, including the ability to reliably add novel microbes into the seed microbiota, as a means of stably storing microbes in plant seeds and propagating them in plant-based bioreactors. Provided are methods for introducing novel microbes into plants or seeds such that the seeds produced by them are able to harbor novel microbes or an altered seed microbiota relative to reference seeds. Provided are methods for introducing novel microbes or substantially augmenting a microbial population in seeds. Additionally provided are methods for introducing populations of multiple symbionts to a seed or altering their abundance or spatial distribution relative to reference seeds. Methods for propagating the cultivars resulting from such seeds are provided such that the plants act as bioreactors for the cultivation of desired microbes. Provided are demonstrations that plant hosts with abundant precedence in agricultural practice can be utilized with the present methods, thereby allowing existing cultivation practices to be adapted to utilize the current methods and compositions.

The present invention offers advantages relative to the prior art practice of coating seeds with defined microbes or administering microbes to plant tissues. Notably, by generating seeds that natively harbor novel microbes or altered microbial populations, such seeds can be, in some cases, propagated repeatedly to allow scalable production of the resulting compositions using common agricultural practices. In some such embodiments, this compatibility with modern agricultural practices provides improved simplicity, reduced cost, and improved market adoption of the technology relative to current approaches of administering endophytes to plants for cultivation in a single generation. In some embodiments, seeds comprising novel microbes provide improved benefits to plants relative to a native seed that has been coated in a similar number of colony forming units of a novel microbe. In some embodiments, seeds comprising novel microbes that have been introduced by the present methods provide improved shelf-life relative to storage of the microbe on its own under similar conditions. In some embodiments, seeds with novel microbes provide improved compatibility with surface-coated chemistries (e.g., biocides, fungicides, antibiotics, etc.) relative to a native seed that has been coated in a similar number of colony forming units of a novel microbe and the same surface chemistries. This compatibility with common agricultural chemistries can improve the use invention's ability to be practiced using established agricultural technologies.

Provided herein are methods of introducing microbes into the seed microbiota to create novel compositions comprising novel bacteria or fungi present in a monocot or dicot host seeds. Additionally provided are methods and compositions of seeds with altered microbiota, wherein the microbiota is substantially augmented, depleted, altered, or spatially redistributed in one or more strains relative to a reference seed population before alteration. As described herein, novel microbes are introduced into plant seeds by artificial inoculation, application, or other infection of a host plant, such as a plant, plant flower, or host plant tissues, with a bacterial or fungal strain of the present invention. These methods are optionally utilized in combination with methods to substantially alter or remove native symbionts within seeds or plant tissues, in order to prime them for administration of novel symbionts.

Because the functions of seed endophytes and the seed microbiota as a whole have the potential to provide diverse benefits to the host, there is a need for novel methods for uniformly and reliably introducing novel microbes into the seed microbiota of crops in order to improve their yield, stress resilience, reliability, and economic viability.

Surprisingly, we discovered a variety of methods for altering the microbiota of seeds produced by crops, including the ability to remove or add novel microbes. Provided are methods for introducing novel microbes into plants or seeds such that the seeds produced by them are able to harbor an altered seed microbiota relative to reference seeds (herein referred to as "altering" a seed microbiota). Provided are methods for substantially augmenting or depleting a microbe or multiple microbes within a seed or altering their abundance or spatial distribution relative to reference seeds that have not had their microbiota altered. Methods for propagating cultivars that produce seeds with such novel microbiota are provided, including demonstrations of the utility for improving the yield and health of resulting crops.

The present invention offers advantages relative to the prior art practice of coating seeds with defined endophytes or administering endophytes to plant tissues. Notably, by generating seeds with altered microbiota that natively harbor novel microbes or altered microbe populations, such seeds can be, in some cases, propagated repeatedly to allow scalable production of the resulting compositions using common agricultural practices. In some such embodiments, this compatibility with modern agricultural practices provides improved simplicity, reduced cost, and improved market adoption of the technology relative to current approaches to administering endophytes to plants. In some embodiments, altered seed microbiota provide improved benefits to plants relative to a native seed that has been coated in a similar number of colony forming units of a novel microbe. In some embodiments, seeds with altered microbiota provide improved shelf-life relative to a native seed that has been coated in a similar number of colony forming units of a novel microbe. Furthermore, the methods describe herein can result in the intercellular localization of the microbe, allowing the transmission of the microbial population to subsequent generations of the plant, thereby potentially offering tremendous advantages of approaches involving seed coatings, which need to be performed every generation. In some embodiments, seeds with altered microbiota provide improved compatibility of endophyte benefits with surface-coated chemistries (e.g., biocides, fungicides, antibiotics, etc.) relative to a native seed that has been coated in a similar number of colony forming units of a novel symbiont and the same surface chemistries.

Provided herein are novel methods of altering the seed microbiota of seeds to include novel compositions of endophytic bacteria or fungi present in a monocot or dicot host having utility for improving a of a plant. Additionally provided are methods and compositions of seeds with altered microbiota, wherein the microbiota is substantially depleted, altered, or spatially redistributed in one or more strains relative to a reference seed population with an unaltered or a native microbiota. As provided herein, seeds with altered microbiota and the resultant plants derived therefrom are useful to enhance agronomic characteristics of, such as the general health of the plant and fields containing the plants, nutrient use efficiency and stress tolerance, as well as to increase yield. Altering the seed microbiota of a selected plant species, OTU, strain or cultivar such that its seeds include one or more types of bacterial or fungal symbionts thus provides mechanisms by which, alone or in parallel with plant breeding and transgenic technologies, yields of commercial seeds and products thereof can be improved. Thus, in one aspect, the invention provides a synthetic combination of a host plant's seeds and a microbe that allows for improved agronomic properties of host plants derived from such seeds. As described herein, the combination is achieved by artificial inoculation, application, or other infection of a host plant, such as a plant, plant seed, or host plant tissues, with a bacterial symbiont strain of the present invention. These methods are optionally utilized in combination with methods to substantially alter or remove native symbionts within seeds or plant tissues, in order to prime them for administration of novel symbionts. These host plants are then utilized as a production process to generate seeds with altered microbiota that have been prepackaged with the novel symbiont strain, such that the plants resulting from these seeds are provided the benefit of the novel symbiont strain.

Novel Seed Compositions

The present invention provides surprisingly generalizable methods for introducing microbes into plant reproductive tissues such that they are able to be passaged into the interior or onto the surface of seeds. Therefore, in one aspect, the invention provides a novel seed comprising a microbe introduced on its surface or within its interior. The seeds described herein can comprise a unique microbial composition.

It is important to note that, none of the methods described in the prior art, particularly the methods disclosed in WO 00/29607 A1, WO 2011/117351 A1, WO 2010/115156 A2, WO 2007/107000 A1, WO 2007/021200 A1, US 2012/144533 A1, U.S. Pat. No. 4,940,834 A, CA 2562175 A1 and WO 2011/082455 A1 (each of which is incorporated by reference in its entirety), disclose methods for providing seeds comprising selected endophytes or microbes. The main goal of these prior art methods is the provision of the endophytes to the very plant treated and not—as is described herein—for producing a mother plant with the microbes of interest and to obtain microbe-containing seeds from this mother plant for generating daughter plants that already contain the microbes and, optionally, passing the microbes further to their own daughter generation. As described herein, the microbe is viably and stably integrated into the seed. Accordingly, the technology provided with the present invention can provide seeds with completely novel characteristics, for example, having a unique microbial community (for example by having one single microbe species being predominantly present in the seeds or a plant that grows from such seeds (e.g., representing more than 1%, for example more than 10%, more than 20%, more than 30%, 50%, or more than 70% or even more than 80% of the total of microbes in the seed)).

A seed is a small embryonic plant enclosed in a covering called the seed coat, usually with some stored food. It is the product of the ripened ovule of gymnosperm and angiosperm plants which occurs after fertilization and some growth within the mother plant. The formation of the seed completes the process of reproduction in seed plants (started with the development of flowers and pollination), with the embryo developed from the zygote and the seed coat from the integuments of the ovule.

A typical seed includes three basic parts: (1) an embryo, (2) a supply of nutrients for the embryo, and (3) a seed coat. The embryo is an immature plant from which a new plant will grow under proper conditions. The embryo has one cotyledon or seed leaf in monocotyledons, two cotyledons in almost all dicotyledons and two or more in gymnosperms. The radicle is the embryonic root. The plumule is the embryonic shoot. The embryonic stem above the point of attachment of the cotyledon(s) is the epicotyl. The embryonic stem below the point of attachment is the hypocotyl. Within the seed, there usually is a store of nutrients for the seedling that will grow from the embryo. The form of the stored nutrition varies depending on the kind of plant. In angiosperms, the stored food begins as a tissue called the endosperm, which is derived from the parent plant via double fertilization. The usually triploid endosperm is rich in oil or starch, and protein. In gymnosperms, such as conifers, the food storage tissue (also called endosperm) is part of the female gametophyte, a haploid tissue. In some species, the embryo is embedded in the endosperm or female gametophyte, which the seedling will use upon germination. In others, the endosperm is absorbed by the embryo as the latter grows within the developing seed, and the cotyledons of the embryo become filled with this stored food. At maturity, seeds of these species have no endosperm and are termed exalbuminous seeds. Some exalbuminous seeds are bean, pea, oak, walnut, squash, sunflower, and radish. Seeds with an endosperm at maturity are termed albuminous seeds. Most monocots (e.g. grasses and palms) and many dicots (e.g. Brazil nut and castor bean) have albuminous seeds. All gymnosperm seeds are albuminous.

The seed coat (the testa) develops from the tissue, the integument, originally surrounding the ovule. The seed coat in the mature seed can be a paper-thin layer (e.g. peanut) or something more substantial (e.g. thick and hard in honey locust and coconut, or fleshy as in the sarcotesta of pomegranate). The seed coat helps protect the embryo from mechanical injury and from drying out. In addition to the three basic seed parts, some seeds have an appendage on the seed coat such an aril (as in yew and nutmeg) or an elaiosome (as in Corydalis) or hairs (as in cotton). A scar also may remain on the seed coat, called the hilum, where the seed was attached to the ovary wall by the funiculus.

The establishment of a stably integrated microbe population within the plant can be detected by a number of methods. The presence of the viable microbe within the seed and the plants and progeny derived from those seeds can be determined using the methods described herein.

There are several ways in which one can determine whether a microbe is located on and/or in the seed. The presence of the microbe can be determined microscopically, using reagents that can detect the microbe (e.g., antibodies that recognize the microbe, or a PCR-based detection system to detect presence of microbe-specific sequences within a seed sample). Alternatively, the location of the microbe within the seed can be determined by sterilizing the surface of the seed using any number of chemical agents (e.g., bleach, detergent, hydrogen peroxide or combinations thereof) to destroy any surface located microbes, and testing for the presence of surviving microbes after homogenizing the surface sterilized seeds under conditions allowing growth of the microbe. Therefore, the loss of microbe viability upon surface sterilization indicates that the microbes are almost exclusively located on the seed surface. In contrast, resistance of the microbe population to such seed sterilization methods indicates an internal localization of the microbes. Alternatively, the presence of microbial DNA after surface sterilization with agents that cross-link or otherwise destroy DNA can be detected using sensitive detection methods such as PCR to establish the presence of the microbe within the seed coat.

Viability of the microbe can be tested after seed surface sterilization, or after removal of the seed coat, by homogenizing the seed and growing the homogenate under conditions that promote growth of the microbe. In the alternative, the presence of microbes can be detected visually or microscopically if the microbes can form a colony that is visible by such inspection. Reagents are also available for the detection of microbes: the stain aniline blue can be used for detecting hyphae (Clark et al., J. Microbiol Methods (1983) 1: 149-155), other assays are known in the art (reviewed, for example, in Hiatt et al., (1999) Crop Science, 39: 796-799, WAG-conjugated fluorophore used by Lanver et al., (2010) Plant Cell 22: 2085-2101).

In some embodiments, the microbe is located on and/or in the seed. In another embodiment, the microbe is located on the seed coat or in the seed (i.e., located within the tissues/compartments contained within the seed coat). In still another embodiment, the microbe is located in the seed. In another embodiment, the microbe is located in the embryo of the seed. In another embodiment, the microbe is located within the endosperm of the seed. The presence of the microbe in the embryo or endosperm, as well as its localization with respect to the plant cells, can be determined using methods known in the art, including immunofluorescence microscopy using microbe specific antibodies, or fluorescence in situ hybridization (see, for example, Amann et al. (2001) Current Opinion in Biotechnology 12:231-236, incorporated herein by reference).

In some embodiments, the microbe is located intercellularly (i.e., between the cells of the plant). For example, at least 1% of the microbes in a seed, for example at least 10%, at least 20%, at least 30%, at least 40%, at least 50%, at least 60%, at least 70%, at least 80%, at least 90% or more of the microbe within the seed is intercellularly located. In another embodiment, at least 1 CFU of the microbe, for example, at least 10 CFU, at least 30 CFU, at least 100 CFU, at least 300 CFU, at least 1,000 CFU or more of the microbe is intercellularly located. In another embodiment, the microbe is located intercellularly and is detectably present within at least 1, at least 2, at least 3, or at least 4 compartments of the embryo, the seed coat, the endosperm, the cotyledon, the hypocotyl, the radicle, or the cotyledons.

Alternatively, in another embodiment, the microbe is located intracellularly (i.e., within the plant cell). For example, at least 1% of the microbes in a seed, for example at least 10%, at least 20%, at least 30%, at least 40%, at least 50%, at least 60%, at least 70%, at least 80%, at least 90% or more of the microbe within the seed is intracellularly located. In another embodiment, at least 1 CFU of the microbe, for example, at least 10 CFU, at least 30 CFU, at least 100 CFU, at least 300 CFU, at least 1,000 CFU or more of the microbe is intracellularly located.

In some embodiments, microbes introduced to seeds have the capacity to perform various metabolic functions. In some such embodiments, the microbe is capable of producing a plant growth hormone (e.g., an auxin). For example, at least 1% of the microbes in a seed, for example at least 10%, at least 20%, at least 30%, at least 40%, at least 50%, at least 60%, at least 70%, at least 80%, at least 90% or more of the microbe within the seed are able to produce auxin. In another embodiment, at least 1 CFU of the microbe, for example, at least 10 CFU, at least 30 CFU, at least 100 CFU, at least 300 CFU, at least 1,000 CFU or more of the microbe is able to produce a hormone.

In some such embodiments, the microbe is capable of solubilizing phosphate. For example, at least 1% of the microbes in a seed, for example at least 10%, at least 20%, at least 30%, at least 40%, at least 50%, at least 60%, at least 70%, at least 80%, at least 90% or more of the microbe within the seed are able to solubilize phosphate. In another embodiment, at least 1 CFU of the microbe, for example, at least 10 CFU, at least 30 CFU, at least 100 CFU, at least 300 CFU, at least 1,000 CFU or more of the microbe is able to solubilizing phosphate.

In some such embodiments, the microbe is capable of growing on nitrogen-free media. For example, at least 1% of the microbes in a seed, for example at least 10%, at least 20%, at least 30%, at least 40%, at least 50%, at least 60%, at least 70%, at least 80%, at least 90% or more of the microbe within the seed are able to grow on nitrogen-free media. In another embodiment, at least 1 CFU of the microbe, for example, at least 10 CFU, at least 30 CFU, at least 100 CFU, at least 300 CFU, at least 1,000 CFU or more of the microbe is able to grow on nitrogen-free media.

In some such embodiments, the microbe is capable of antagonizing a plant pathogen. For example, at least 1% of the microbes in a seed, for example at least 10%, at least 20%, at least 30%, at least 40%, at least 50%, at least 60%, at least 70%, at least 80%, at least 90% or more of the microbe within the seed are able to produce antagonize a plant pathogen. In another embodiment, at least 1 CFU of the microbe, for example, at least 10 CFU, at least 30 CFU, at least 100 CFU, at least 300 CFU, at least 1,000 CFU or more of the microbe is able to antagonizing a plant pathogen.

In some such embodiments, the microbe is capable of sequestering iron. For example, at least 1% of the microbes in a seed, for example at least 10%, at least 20%, at least 30%, at least 40%, at least 50%, at least 60%, at least 70%, at least 80%, at least 90% or more of the microbe within the seed are able to sequestering iron. In another embodiment, at least 1 CFU of the microbe, for example, at least 10 CFU, at least 30 CFU, at least 100 CFU, at least 300 CFU, at least 1,000 CFU or more of the microbe is able to sequester iron.

In some such embodiments, the microbe is capable of producing acetoin/butanediol. For example, at least 1% of the microbes in a seed, for example at least 10%, at least 20%, at least 30%, at least 40%, at least 50%, at least 60%, at least 70%, at least 80%, at least 90% or more of the microbe within the seed are able to produce acetoin/butanediol. In another embodiment, at least 1 CFU of the microbe, for example, at least 10 CFU, at least 30 CFU, at least 100 CFU, at least 300 CFU, at least 1,000 CFU or more of the microbe is able to produce acetoin/butanediol.

The methods described herein permit the alteration of the seed with novel or endogenous microbes. The advantage of these methods is that, when desired, the seed can be programmed with microbes that can exert a beneficial trait to distinct tissues or portions of the plant. As such, in one embodiment, inoculation with the microbes permits the localization of microbes into tissues, portions in which they are normally not associated.

In addition, in some cases, the microbe present in the seed is capable, upon germination of the seed into a vegetative state, of localizing to a different tissue of the plant. For example, the microbe can be capable of localizing to any one of the tissues in the plant, including: the root, adventitious root, seminal root, root hair, shoot, leaf, flower, bud, tassel, meristem, pollen, pistil, ovaries, stamen, fruit, stolon, rhizome, nodule, tuber, trichome, guard cells, hydathode, petal, sepal, glume, rachis, vascular cambium, phloem, and xylem.

In yet another embodiment, the invention provides seed compositions comprising a microbe, in which the microbe is located on and/or inside the seed. In still another embodiment, the invention provides seed compositions in which the microbe is located predominantly on the surface the seed. In another embodiment, the microbe is located in the seed. For example, the microbe is located in the embryo of the seed. In another embodiment, the microbe is located in the endosperm of the seed.

The presence of the microbe in the embryo or endosperm, as well as its localization with respect to the plant cells, can be determined using methods known in the art, including immunofluorescence microscopy using microbe specific antibodies, or fluorescence in situ hybridization (see, for example, Amann et al. (2001) Current Opinion in Biotechnology 12:231-236, incorporated herein by reference).

In another embodiment, the seed can contain a second microbe, which is also heterologous to the seed, and introduced into the seed using the methods described herein.

In another embodiment, microbes are present at a defined concentration within the seed. In one embodiment, each seed contains at least 1 CFU for example, 10 CFU for example, at least 100 CFU, at least 300 CFU, at least 1,000 CFU, at least 3,000 CFU or more, of the microbe.

In yet another embodiment, the microbe is present in the seed in a detectable level, and represents at least 0.1% of the total microbe population within the seed, for example at least, at least 0.5%, at least 1%, at least 2%, at least 3%, at least 4%, at least 5%, at least 10%, least 20%, at least 30%, at least 40%, at least 50%, at least 60%, at least 70%, at least 80%, at least 90%, at least 95%, at least 99%, or 100% of the total microbe population in the seed. The presence and quantity of other microbes can be established by the FISH, immunofluorescence and PCR methods described herein. Furthermore, homogenates of the seed can be plated onto various media, and the percentage of the total population represented by the microbe can be determined by counting the microbial colonies (e.g., number represented by the microbe vs. total microbe count).

According to one embodiment, provided is a seed preparation containing seeds having more than 1%, for example more than 3%, more than 5%, more than 10%, more than 20%, more than 30%, for example more than 40%, or more than 50%, of the endophytic microorganisms are *Burkholderia phytofirmans*, especially *Burkholderia phytofirmans* PsJN (DSM17436); *Pantoea* sp. FD17 or *Paenibacillus* sp. S10., *Actinobacter* sp. S9, *Bradyrhizobium* sp. NC92 and *Bradyrhizobium japonicum* TAL379. In another embodiment, a maize seed produced by the methods described herein is provided wherein the microorganisms contained within the seed are *Burkholderia phytofirmans*, especially in a population density of 1 to $10^5$ CFU/g fresh weight of seed. It is known that in maize, usually the viable population densities are relatively low (for sweet corn, it was reported that such concentrations are below $10^1$ CFU/g fresh weight (Kaga et al. Microbes Environ 24 (2009), 154-162)); in contrast thereto, the seeds according to this embodiment contain at least $10^1$ for example at least $10^2$, at least $10^3$, or at least $10^4$ CFU/g fresh weight of one species. In some embodiments this species includes *Burkholderia phytofirmans* (strain PsJN). Accordingly, the microbe concentration of such seeds reproducibly contains a predominant strain and particularly a strain that has been propagated in cell culture, which is not the case in natural plants or plants having been inoculated with prior art inoculation methods.

In one embodiment, the resulting seeds, or the plant that is grown from such seeds, have a detectably altered chemical composition or metabolomic profile where the altered composition is due only to the presence of the microbe. In another embodiment, the resulting seeds, or the plant that is grown from such seeds, have a detectably altered gene expression profile that is linked to the presence of the microbe.

In some embodiments, the seeds obtained by the present method can be treated like normal seeds. The beneficial properties that may be conferred by the microbes remain safely packed inside the seed preventing the exposure of hazards from outside (which usually causes damage to cultures which are applied when the seeds are only coated). Accordingly, the seeds may be stored for considerable time without significant loss of their viability or properties. In one embodiment, the plant seed obtained by the present method containing microorganisms from the plant is stored for at least 1 day, at least 1 week, at least 2 weeks, at least 1 month, for example at least 3 months, or at least 6 months.

Also much longer storage times are possible for the seeds produced according to the present invention. In another embodiment, the plant seed obtained by the present method containing microorganisms from the plant is stored for at least 12 months, for example for at least 2 years, or for at least 3 years.

The method according to the present invention is suitable for providing virtually any endophyte-containing seed, because the transfer of the microorganisms from the flower to the seed is a way with low hazard exposure (to plant and endophyte). It is specifically suitable for producing seeds with a microbe which is in principle known to naturally proliferate in plants, especially in the given plant, i.e., a "naturally obtainable endophyte". These endophytes are derivable from natural sources from the same plant type or from other plant types. According to one embodiment, the endophytic microorganism is therefore a naturally obtainable endophyte.

Novel Populations of Seeds

Also contemplated herein are populations of seeds. There is emerging evidence suggesting tremendous heterogeneity of the microbiome population within a single plant. For example, Rosenblueth et al. (2012) Acta Hort. (ISHS) 938: 39-48 documented seed-to-seed variability in bacterial endophyte populations even when the seeds are taken from the same cob. Further, when large numbers of seeds were analyzed together, Johnston-Monje and Raizada (2011) PLoS ONE 6(6): e20396, found that the observed microbes in Zea species were limited to a small number of taxa and highly conserved across ancient and modern varieties. Together, these results indicate (i) that seeds within a population can harbor heterogeneous microbial populations and (ii) that even over hundreds of generations, the microbial taxa detected in Zea seeds is conserved, thereby implying that introducing novel symbionts to seeds in a single step or single generation is likely to be highly challenging. As such, a method that can consistently provide uniform microbial population (either qualitatively and quantitatively) within the shelf-stable vehicle of an agricultural seed, particularly where the microbe is capable of scalably propagating within the host plant, would be surprising and novel. The methods described herein contemplate the generation of seeds with highly uniform introduction of novel microbes. The benefit of producing uniform seeds in terms of its microbiome population is that the resulting plants are expected to more consistently propagate the desired microbes and benefit from their microbial activities.

Therefore, in another aspect, the invention provides a substantially uniform population of isolated seeds. The uniformity of the microbes within the seed population can be measured in several different ways. In one embodiment, a substantial portion of the population of seeds, for example at least 10%, at least 20%, at least 30%, at least 40%, at least 50%, at least 60%, at least 70%, at least 75%, at least 80%, at least 90%, at least 95% or more of the seeds in a population, contains a viable microbe. In another embodiment, a substantial portion of the population of seeds, for example at least 10%, at least 20%, at least 30%, at least 40%, at least 50%, at least 60%, at least 70%, at least 75%, at least 80%, at least 90%, at least 95% or more of the seeds in a population contain a threshold number of viable microbe is at least 1 CFU per seed, at least 10 CFU per seed, for example, at least 100 CFU, at least 300 CFU, at least 1,000 CFU, at least 3,000 CFU or more, of the microbe per seed.

In some cases, a substantial portion of the population of seeds, for example, at least 10%, at least 20%, at least 30%, at least 40%, at least 50%, at least 60%, at least 70%, at least 75%, at least 80%, at least 90%, at least 95% or more of the seeds in a population, contains an endophyte that is able to perform one of the following functions, including: to stimulate plant growth, grow on nitrogen-free media, solubilize phosphate, sequester iron, secrete RNAse, antagonize pathogens, catabolize the precursor of ethylene, produce auxin and acetoin/butanediol. In some cases, a substantial portion of the population of seeds, for example, at least 10%, at least 20%, at least 30%, at least 40%, at least 50%, at least 60%, at least 70%, at least 75%, at least 80%, at least 90%, at least 95% or more of the seeds in a population, exhibits at least one of the endophyte community attributes listed in herein (e.g., total CFUs, presence of a taxa, absence of a taxxa, spatial distribution, intercellular colonization, functional properties of endophytes, presence of monoclonal strain, presence of conserved subset of microbial plasmid repertoire, microbe isolated from habitat that is distinct from the location of seed production, etc.).

In other cases, the genetic sequence of the microbe can be used to measure the genetic similarity of the virus within a population. In one embodiment, a substantial proportion of the seeds, for example, at least 10%, for example at least 20%, at least 30%, at least 40%, at least 50%, at least 60%, at least 70%, at least 80%, at least 90%, at least 95% or more of the seeds contain the same species or strain of microbe, for example, as determined by DNA sequence analysis. In one embodiment, a substantial proportion of the seeds, for example, at least 10%, for example at least 20%, at least 30%, at least 40%, at least 50%, at least 60%, at least 70%, at least 80%, at least 90%, at least 95% or more of the seeds contain the microbe of monoclonal origin, for example, as determined by DNA sequence analysis.

Increased uniformity of microbes in plants or seeds can also be detected by measuring the presence of non-genomic nucleic acids present in the microbes. For examples, where the microbe that is inoculated into the plant is known to harbor a plasmid or episome, the presence of the plasmid or episome can be detected in individual plants or seeds by using conventional methods of nucleic acid detection. Therefore, in one embodiment, a substantial portion of the population of seeds, for example at least example at least 10%, at least 20%, at least 30%, at least 40%, at least 50%, at least 60%, at least 70%, at least 75%, at least 80%, at least 90%, at least 95% or more of the seeds in a population, has a detectable presence of the microbial plasmid or episome.

Increased uniformity of the microbes' epigenetic status can also be used to detect increased uniformity. For example, where a microbe that has been inoculated by a plant is also present in the plant (for example, in a different tissue or portion of the plant), or where the introduced microbe is sufficiently similar to a microbe that is present in some of the plants (or portion of the plant, including seeds), it is still possible to distinguish between the inoculated microbe and the native microbe, for example, by distinguishing between the two microbe types on the basis of their epigenetic status. Therefore, in one embodiment, the epigenetic status is detected in microbes across individual seeds or the plants that grow from such seeds.

The methods described herein enable the creation of completely new seed/microbe combinations. One of the properties of seeds obtainable by the present invention is the possibility to provide predominant endophyte populations in the seeds. Normally, seeds containing endophytes have been characterized to contain only a limited number of taxa of microbes. The method according to the present invention enables, in some cases, the production of seeds with a predominant species of endophytic microorganism. Accordingly, in some embodiments, seed preparations which are provided by the present invention contain seeds having an endophytic microorganism population wherein more than 30%, for example more than 40%, or more than 50%, of the endophytic microorganisms represent the inoculant strain. This means that most (more than 50%, for example more than 60%, or more than 70%) of the seeds in the preparation contain more than 30%, for example more than 40%, or more than 50%, endophytic microorganisms comprising the inoculant strain.

In still another embodiment, in a substantial portion of the population of seeds, for example at least 1%, at least 10%, at least 20%, at least 30%, at least 40%, at least 50%, at least 60%, at least 70%, at least 75%, at least 80%, at least 90%, at least 95% or more of the seeds in a population, the microbe represents at least 10%, least 20%, at least 30%, at least 40%, at least 50%, at least 60%, at least 70%, at least 80%, at least 90%, at least 95%, at least 99%, or 100% of the total microbe population in the seed.

Uniformity of the seed population can also be measured using other means. The uniformity can be measured, for example, on the basis of the absence or exclusion of a microbe (i.e., a microbe that was not inoculated according to the methods of the invention). As such, in one embodiment, the invention provides a population of seeds in which a substantial portion of the seeds, for example at least 1%, at least 10%, at least 20%, at least 30%, at least 40%, at least 50%, at least 60%, at least 70%, at least 75%, at least 80%, at least 90%, at least 95% or more of the seeds, do not contain a reference microbe, wherein the reference microbe may be an endogenous microbe.

It is also known that certain viruses are associated with endophytic fungi (such as the *Curvularia* thermal tolerance virus (CThTV) described in Márquez, L. M., et al., (2007). Science 315: 513-515). Therefore, the presence and quantity of a virus can be used to measure uniformity. For example, where the inoculated microbe is known to be associated with a virus, the presence of that virus can be used as a surrogate indicator of uniformity. Therefore, in one embodiment, a substantial portion of the seeds, for example at least 1%, at least 10%, at least 20%, at least 30%, at least 40%, at least 50%, at least 60%, at least 70%, at least 75%, at least 80%, at least 90%, at least 95% or more of the seeds, contain the virus. In other embodiments, where one or more of the endogenous microbes contain associated viruses which are not found in, and not compatible with the inoculated microbe, the loss (i.e., absence) of the virus can be used to measure uniformity of the seed population. As such, in another embodiment, a substantial portion of the seeds, for example at least 1%, at least 10%, at least 20%, at least 30%, at least 40%, at least 50%, at least 60%, at least 70%, at least 75%, at least 80%, at least 90%, at least 95% or more of the seeds, do not contain the virus. In other cases, the genetic sequence of the virus can be used to measure the genetic similarity of the virus within a population. In one embodiment, a substantial proportion of the seeds, for example, at least 10%, for example at least 20%, at least 30%, at least 40%, at least 50%, at least 60%, at least 70%, at least 80%, at least 90%, at least 95% or more of the seeds contain the same virus, for example, as determined by sequence analysis.

In another aspect, the seeds according to the present invention provide a marketable seed product containing a predetermined weight or volume of seeds with a uniform endophyte composition. For example, a marketable seed product containing at least 100 g seeds, for example at least 1 kg seeds, at least 5 kg seeds, at least 10 kg seeds, can be provided by the method according to the present invention that contains—as a whole product—more than 1%, for example more than 5%, more than 10%, more than 20%, more than 30%, more than 40%, especially more than 50%, of a single species of an endophytic microorganism, i.e., the inoculant strain. According to a preferred embodiment, the present invention provides a marketable seed product containing at least 100 g seeds, for example, at least 1 kg seeds, for example at least 5 kg seeds, at least 10 kg seeds, wherein—as a whole product—more than 50%, for example, more than 60%, more than 70% of the microbial population is represented by a single species of an endophytic microorganism, i.e., the inoculant strain. According to another embodiment, the present invention provides a marketable seed product containing at least 100 g seeds, for example at least 1 kg seeds, at least 5 kg seeds, at least 10 kg seeds or more, wherein—as a whole product—more than 20%, more than 30%, more than 40%, more than 50%, more than 60%, more than 75%, more than 80%, more than 90%, or more, of the microbial population is represented by a single species (the microorganism of the inoculant strain) are contained.

Such uniformity in microbial composition is unique and is extremely advantageous for high-tech and/or industrial agriculture. It allows significant standardization with respect to qualitative endophyte load of seed products. The term "marketable seed product" means any commercially usable product containing plant seeds in a suitable package (e.g., a box, a bag, an envelope or any other container used for storing, shipping or offering plant seeds for sale). Suitable volumes or weights are those that are currently used for plant seeds (e.g., the at least 100 g, at least 1, 5 or 10 kg; but also 25 or more, 40 or more, 50 kg or more, even 100 kg or more, 500 kg or more, 1 t or more, etc.). Suitable containers or packages are those traditionally used in plant seed commercialization: however, also other containers with more sophisticated storage capabilities (e.g., with microbiologically tight wrappings or with gas- or water-proof containments) can be used. The amount of endophytes (qualitatively and quantitatively) contained in the seeds or in the marketable seed product as a whole can be determined by standard techniques in microbiology readily available to any person skilled in the art of plant endophyte analysis.

In some cases, a sub-population of agricultural seeds can be further selected on the basis of increased uniformity, for example, on the basis of uniformity of microbial population. For example, individual seeds of pools collected from individual cobs, individual plants, individual plots (representing plants inoculated on the same day) or individual fields can be tested for uniformity of microbial density, and only those pools meeting specifications (e.g., at least 80% of tested seeds have minimum density, as determined by quantitative methods described elsewhere) are combined to provide the agricultural seed sub-population.

The methods described herein can also comprise a validating step. The validating step can entail, for example, growing some seeds collected from the inoculated plants into mature agricultural plants, and testing those individual plants for uniformity. Such validating step can be performed on individual seeds collected from cobs, individual plants, individual plots (representing plants inoculated on the same day) or individual fields, and tested as described above to identify pools meeting the required specifications.

Agricultural Field

Plants can be grown individually to propagate the desired microbes in indoor or outdoor settings. An advantage of the present invention is that allows multiple plants harboring novel symbionts to be grown under agricultural methods as a means of providing improved uniformity of microbe-derived benefits to farmers.

Provided herein are indoor arrangements of populations of plants generated from the methods of the present invention. Such arrangements can include at least a defined number of plants of the present invention, such as at least 1, 2, 3, 5, 10, 15, 20, 30, 50, 100, 200, 500, 1000, 5000, or 10000 plants.

Also provided herein are agricultural fields that contain population of plants generated from the methods of the present invention. Agricultural fields can occupy as little as 100 square feet or less, or can occupy hundreds or thousands of acres. Area of field containing a population of microbe-associated plants can be measured in square feet, such as at least 100, 500, 1000, 5000, 10,000, 50,000 or greater than 50,000 square feet, or can be measured in acres, such as 1, 2, 3, 4, 5, 6, 7, 8, 9, 10, 25, 50, 100, 250, 500, 750, 1000, 5000, 10000, 50000 or greater than 50000 acres. The field can also be measured in hectares, for example at least 1, 5, 10, 20, 100, 300, 500, 1,000, 10,000 hectares or more. Additionally, a field containing a population of microbe-associated plants can be characterized by the number of plants in the population, generally a field is at least two, such as 1, 2, 3, 4, 5, 6, 7, 8, 9, 10, 25, 50, 100, 250, 500, 750, 1000, 5000, 10000, 50000, 100000, 250000, 500000, 750000, 1000000 or greater than 1000000 plants. A field is generally a contiguous area but may be separated by geographical features such as roads, waterways, buildings, fences, and the like known to those skilled in the art. Because the microbe-associated plants described herein benefit from an increased level of uniformity of germination and other characteristics, it is desirable to maximize the percentage of plants containing microbes. For example, at least 50% (e.g., 50%, 60%, 70%, 80%, 90%, 95%, 99% or greater than 99%) of the plants contain the microbes.

Microbes Useful for the Invention

The methods described herein are also useful for culturing microbes. This is particularly useful where the particular microbe is difficult to culture using traditional growth media. Therefore, in another aspect, disclosed herein are methods for growing a microbe, said method comprising the following steps. A preparation of inoculant microbes that is capable of growing and dividing in a plant is provided. A plant is then contacted with the preparation of microbes to produce an inoculated plant. The microbe-inoculated plant is then placed under conditions that permit the microbe to grow and divide in the inoculated plant.

In some cases, the microbe can be transmitted to and remain viable in the seed of the inoculated plant. The seed of the plant can provide an environment that allows the microbe to withstand the stresses of desiccation, temperature variation, and be preserved for extended periods of time. Therefore, in another embodiment, disclosed herein are methods of preserving the viability of a microbe by encapsulation within a seed of a plant, by obtaining the seed comprising the microbe from the plant, wherein the microbe is located inside the seed coat, and wherein the microbe remains viable within the seed. Where the microbe remains viable in the seed, the microbe may also be transmitted and propagated once the seed germinates and develops into a plant. Therefore, in still another embodiment, the microbe can be isolated from the progeny of the inoculated plant.

The microbe can be fungal in origin. Alternatively, the microbe can be bacterial in origin. In still other cases, the microbe can be a community of microbes. In one embodiment, the microbe can be any one of the microorganisms in Table 15.

In one embodiment, the microbe can be a bacterium. The bacterium can be any bacterium, so long as the bacterium can remain viably incorporated on and/or in the seed. In some cases, it can be a gram-positive bacterium. In other cases, it can be a gram-negative bacterium. The bacterium can be any bacterium selected from the genera listed in TABLE 1. According to one particular embodiment, the microorganism is an endophytic bacterium, selected from *Burkholderia, Rhizobium, Bradyrhizobium, Mesorhizobium,* and *Sinorhizobium, Herbaspirillum, Methylobacterium, Azospirillum, Acetobacter, Arthrobacter, Bacillus, Paenibacillus, Streptomyces, Enterobacter,* and *Pseudomonas, Pantoea* and *Enterobacter,* especially *Burkholderia phytofirmans.*

In another embodiment, the bacterium can be a bacterium that is associated with a plant, for example a bacterium that is normally an endophyte, an epiphyte, or a rhizospheric bacterium. In one embodiment, the bacterium is an endophytic bacterium. In another embodiment, the bacterium is an endophytic bacterium selected from the bacteria listed in TABLE 2 and TABLE 3. Endophytic bacteria also include those bacteria having a 16S rRNA sequence selected from the group consisting of SEQ ID NOs: 1-160. In another embodiment, the bacterium is not an endophyte, for example, not among the bacteria listed in TABLE 2 and TABLE 3, and not a bacterium having a 16S rRNA sequence selected from the group consisting of SEQ ID NOs: 1-160.

In another embodiment, the microbe can be a fungus. The microbe can be from any one of the genera selected from the genera listed in TABLE 4. According to some embodiments, the endophytic microorganism is an endophytic fungus selected from *Curvularia, Mycorrhiza, Pififmospora, Glomeromycota, Pififmospora, Fusarium, Paecilomyces, Bionectria, Metarhizium, Trichoderma, Acremonium* and *Colletotrichum.*

In another embodiment, the fungus can be a fungus that is associated with a plant, for example a fungus that is normally an endophyte, an epiphyte, or a rhizospheric fungus. In one embodiment, the fungus is selected from the endophytic fungi listed in TABLE 5. In still another embodiment, the fungus is not an endophyte, for example, not among the fungi listed in TABLE 5.

It is also possible to use the present method for providing seeds with artificially created or optimized microorganisms, e.g., recombinantly engineered bacteria or fungi; or strains which have been optimized by various culture techniques and/or selection rounds. Another embodiment of the present invention is therefore to use a recombinantly produced (i.e., genetically engineered) microorganism.

In some cases, the present invention contemplates the use of microbes that do not normally associate with the plants. For purposes of the invention, it is only necessary that the microbe be sufficiently compatible with the plant environment such that it is able to eventually be located on and/or in the seed of the plant. The microbe can also be an organism that normally associates with plants, for example, as an endophyte, an epiphyte, a microbe associated with the surface of a plant or seed (an epispheric microbe), or a rhizospheric microbe, or a soil microbe. In one embodiment, the microbe is associated with the plant rhizosphere.

It is to be understood that, upon inoculation and association with the plant, the microbe can confer a detectable change to the plant when compared with a control plant that was not inoculated with the microbe. The detectable changes that can be conferred by the microbe either directly or indirectly, through its interactions with the host plant are described herein elsewhere.

In some embodiments, the microbe useful for the present invention does not include any microbe which can alter the sequence of the host plant's chromosomal DNA, for example, by inserting a foreign nucleic acid. Therefore, in a particular embodiment, the microbe is not from the genus

*Agrobacterium*. In a further embodiment, the microbe is not *Agrobacterium tumafaciens*, *Agrobacterium rhizogenes*, *Rhizobium* sp., *Rhizobium* sp. NGR234, *Rhizobium leguminosarum Madison*, *R. leguminosarum* USDA2370, *R. leguminosarum* bv. *trifolii* USDA2408, *R. leguminosarum* bv. *phaseoli* USDA2668, *R. leguminosarum* 2370G, *R. leguminosarum* 2370LBA, *R. leguminosarum* 2048G, *R. leguminosarum* 2048LBA, *R. leguminosarum* bv. *phaseoli*, *R. leguminosarum* bv. *phaseoli* 2668G, *R. leguminosarum* bv. *phaseoli* 2668LBA, *R. leguminosarum* RL542C, *R. leguminosarum* bv. *viciae*, *R. leguminosarum* bv. *trifolii*, *Rhizobium etli* USDA 9032, *R. etli* bv. *phaseoli*, *Rhizobium tropici*, *Mesorhizobium* sp., *Mesorhizobium loti* ML542G, *M. loti* ML4404, *Sinorhizobium* sp., *Sinorhizobium meliloti* SD630, *S. meliloti* USDA1002, *Sinorhizobium fredii* USDA205, *S. fredii* SF542G, *S. fredii* SF4404, *S. fredii* SM542C, *Bradyrhizobium* sp., *Bradyrhizobium japonicum* USDA 6, and *B. japonicum* USDA 110, *Mesorhizobium loti*, *Sinorhizobium meliloti*, *Ochrobactrum* sp. In another embodiment, the microbe is not any of the microorganisms listed on Table 15. In some cases, it is possible, and in some cases likely, for the newly colonized microbe to make minor changes to the plant genome, resulting in changes to the plant's gene expression, or the introduction of minor sequence changes. In some embodiments, the microbe useful for the invention is not a pathogenic microbe.

Endogenous Endophytes

In one particular embodiment, the microbe is an endophytic microbe that is normally associated with the plant or seed that is being inoculated, or is normally associated with another plant of the same species. In one embodiment, the endophyte is associated with the seed of the plant. In another embodiment, the endophyte is associated with other portions of the plant, and is selected from the portions consisting of: the root, adventitious root, seminal root, root hair, shoot, leaf, flower, bud, tassel, meristem, pollen, pistil, ovaries, stamen, fruit, stolon, rhizome, nodule, tuber, trichome, guard cells, hydathode, petal, sepal, glume, rachis, vascular cambium, phloem, and xylem.

Where the endophyte used for inoculation is a microbe that is normally associated with the plant, the method herein provides means of increasing the uniformity of distribution of the microbe in a population of plants or a portion thereof, including the seeds. For example, the method of inoculation results in seeds derived from inoculated plants, or plants derived from such seeds and progeny thereof, wherein the seed population is substantially uniform with respect to the microbial population across individual seeds derived from inoculated plants, or plants derived from such seeds and progeny thereof. Where the microbe is able to produce a beneficial product, the seed population can also be substantially uniform with respect to the beneficial product across individual seeds derived from inoculated plants, or plants derived from such seeds and progeny thereof. In one embodiment, the inoculant microbe is present in the agricultural seed, or any agricultural plant derived therefrom, at a higher level in a specific tissue than the inoculant microbe is natively present in the specific tissue in an agricultural seed or any agricultural plant derived therefrom. In another embodiment, the inoculant microbe is present in the agricultural seed, or any agricultural plant derived therefrom, at a higher level than any other microbe present in the agricultural seed or any agricultural plant derived therefrom.

Substantial uniformity can be measured using any of the means known in the art, or as described herein elsewhere.

Inoculation with Multiple Strains of Microbes

In another embodiment, the present invention contemplates methods of inoculating a plant with a plurality of microbes, as well as seed compositions comprising a plurality of microbes on and/or in the seed. The methods according to this embodiment can be performed in a manner similar to those described herein for single microbe inoculation. In one example, multiple microbes can be prepared in a single preparation that is contacted with the plant. Alternatively, a plant can be contacted sequentially with a preparation containing the first microbe, then with a preparation containing the second microbe. The first microbe and second microbe can be contacted either simultaneously, minutes apart (for example at least 1 minute, at least 2 minutes, at least 5 minutes, at least 10 minutes, at least 15 minutes, at least 20 minutes, at least 30 minutes, at least 40 minutes, at least 50 minutes apart), hours apart (for example at least 1 hour apart, at least 2 hours apart, at least 3 hours apart, at least 3 hours apart, at least 4 hours apart, at least 6 hours apart, at least 9 hours apart, at least 12 hours apart, at least 18 hours apart), days apart (for example, at least 1 day apart, at least 2 days apart, at least 3 days apart, at least 4 days apart, at least 5 days apart, or at least 6 days apart), weeks apart (for example at least 1 week apart, 2 weeks apart, 3 weeks apart, 4 weeks apart), or months apart (for example at least 1 month apart, 2 months apart, 3 months apart, 4 months apart), or more. In some other cases, the plant may be contacted with a first preparation of first microbes. The seeds of the inoculated plant are then collected, and allowed to germinate. The resulting progeny, which can optionally be tested to ensure the presence of the first microbe, is then inoculated with a preparation containing the second microbes, or a preparation containing the multiple microbes (e.g., the first and second microbes). The seeds of the inoculated progeny are then collected and tested for the presence of multiple microbes (e.g., the first and second microbes) on and/or in the seed. The above steps can be repeated where more than two microbes are to be inoculated onto a plant.

Where multiple microbes are inoculated onto a single plant, any or all of the microbes may be capable of conferring a beneficial trait onto the host plant. In some cases, all of the microbes are capable of conferring a beneficial trait onto the host plant. The trait conferred by each of the microbes may be the same (e.g., both improve the host plant's tolerance to a particular biotic stress), or may be distinct (e.g., one improves the host plant's tolerance to drought, while another improves phosphate utilization). In other cases the conferred trait may be the result of interactions between the microbes.

Non-Endophytes

In still another embodiment, contemplated are the use of microbes which are not endophytes. In this embodiment, the microbe can be a microorganism that is normally associated with a plant, for example, a microbe that is located on surface of a plant or portion thereof, a microbe that is located on the epidermis of a plant or portion thereof, a microbe that is located within the rhizosphere of a plant, or a microbe that is located in the soil. In one embodiment, the microbe is a rhizospheric microbe. In another embodiment, the microbe is an epiphytic microbe. In still another embodiment, the microbe is normally located on the epidermis of the plant or portion thereof. In yet another embodiment the microbe is normally associated with the surface of a seed.

On the other hand, the microbe may be one that is normally not associated with a plant.

Such a microbe can be any microbe, so long as it is compatible with the plant environment and can be viably incorporated on and/or in the seed.

Microbes that Localize to Distinct Adult Plant Tissues

Microbes useful for the invention can also be classified according to their localization. Some microbes are inherently seed localized, and may not redistribute to other compartments upon germination. Other microbes may be inherently localized to other portions of a plant such that, if present on and/or in the seed, the microbe is capable of redistributing to another portion or tissue of the plant. As such, in one, the microbe with which plants are inoculated is capable, upon germination of the seed into a vegetative state, of localizing to a different tissue of the plant. For example, the microbe can be capable of localizing to any one of the tissues in the plant, including: the root, adventitious root, seminal root, root hair, shoot, leaf, flower, bud, tassel, meristem, pollen, pistil, ovaries, stamen, fruit, stolon, rhizome, nodule, tuber, trichome, guard cells, hydathode, petal, sepal, glume, rachis, vascular cambium, phloem, and xylem. In one embodiment, the microbe is capable of localizing to the root and/or the root hair of the plant. In another embodiment, the microbe is capable of localizing to the photosynthetic tissues, for example, leaves and shoots of the plant. In other cases, the microbe is localized to the vascular tissues of the plant, for example, in the xylem and phloem. In still another embodiment, the microbe is capable of localizing to the reproductive tissues (flower, pollen, pistil, ovaries, stamen, fruit) of the plant. In another embodiment, the microbe is capable of localizing to the root, shoots, leaves and reproductive tissues of the plant. In still other embodiments, the microbe is capable of localizing to substantially all, or all, tissues of the plant.

In certain embodiments, the microbe is not localized to the root of a plant. In other cases, the microbe is not localized to the photosynthetic tissues of the plant.

Endophytes

In one embodiment, the microbe is an endophytic microbe that was isolated from a different plant than the inoculated plant. For example, in one embodiment, the microbe can be an endophyte isolated from a different plant of the same species as the inoculated plant. In some cases, the microbe can be isolated from a species related to the inoculated plant.

The breeding of plants for agriculture, as well as cultural practices used to combat microbial pathogens, may have resulted in the loss in modern cultivars of the endophytes present in their wild ancestors, or such practices may have inadvertently promoted other novel or rare plant-microbe interactions, or otherwise altered the microbial population. The former is the case in maize and its phylogenetically confirmed, direct wild ancestor, *Parviglumis* teosinte (*Zea mays* ssp. *Parviglumis*). Although both species have seeds that appear to contain a common core of endophytic bacterial species, the relative abundance of certain groups is higher in seeds of teosinte than modern corn [Johnston-Monje and Raizada. Plos One 6(6): e20396(2011)]. It is possible that this higher diversity and titer of endophytes in the ancestor is correlated with an equally wide range of physiological responses derived from the symbiosis that allow the plant to better adapt to the environment and tolerate stress. In order to survey plant groups for potentially useful microbes, seeds of their wild ancestors, wild relatives, primitive landraces, modern landraces, modern breeding lines, and elite modern agronomic varieties can be screened for microbial endophytes by culture and culture independent methods as described herein.

In some cases, plants are inoculated with microbes that are heterologous to the seed of the inoculated plant. In one embodiment, the microbe is derived from a plant of another species. For example, a microbe that is normally found in dicots is applied to a monocot plant (e.g., inoculating corn with a soy bean-derived microbe), or vice versa. In other cases, the microbe to be inoculated onto a plant can be derived from a related species of the plant that is being inoculated. In one embodiment, the microbe can be derived from a related taxon, for example, from a related species. The plant of another species can be an agricultural plant. For example, a microbe derived from *Hordeum irregulare* can be used to inoculate a *Hordeum vulgare* L., plant. Alternatively, it can be derived from a 'wild' plant (i.e., a non-agricultural plant). For example, microbes normally associated with the wild cotton *Gossypium klotzschianum* can be used to inoculate commercial varieties of *Gossypium hirsutum* plants. As an alternative example of deriving an endophyte from a 'wild' plant, endophytic bacteria isolated from the South East Asian jungle orchid, *Cymbidium eburneum*, can be isolated and testing for their capacity to benefit seedling development and survival of agricultural crops such as wheat, maize, soy and others [Faria, D. C., et al., (2013) *World Journal of Microbiology and Biotechnology.* 29(2). pp. 217-221]. In other cases, the microbe can be isolated from an ancestral species of the inoculated plant. For example, a microbe derived from *Zea diploperennis* can be used to inoculate a commercial variety of modern corn, or *Zea mays*.

In still other embodiments, the microbe can be an endophyte that normally resides in a tissue/organ other than the seed of the plant. For example, the microbe can be one that normally resides in the roots of a plant. Alternatively, the microbe can be one that normally resides in the leaves. In some cases, such localization may be exclusive (i.e., the microbe normally resides exclusively in the leaves of the plant).

Selection of Plant Species from Desired Habitats for Isolation of Microbial Endophytes Different environments can contain significantly different populations of microbes. For example, geographically isolated soils from different parts of the Americas have been shown to differ in 96% of the bacterial species they contain [Fulthorpe, R. R, et al., (2008) International Society for Microbial Ecology Journal. 2(9):901-910]. Soils containing different microbial populations can strongly influence the endophytic bacterial population observed inside *Arabidopsis* [Lundberg, D., et al., Nature (2012) 488, 86-90] illustrating that the environment can at least partially alter a plant's associated microbial population. This suggests that plants growing and especially thriving in choice environments are colonized by different and perhaps beneficial microbes, whose isolation and inoculation onto crop plants may aid these plants to better survive in the same choice environment or to better resist certain stresses encountered in a normal agricultural environment. For instance, at least some of the bacteria isolated from plants growing in arid environments are expected to confer drought tolerance to host plants they are transplanted onto [Marasco, R., et al., (2012) PLoS ONE 7(10): e48479]. Additionally, novel symbionts may be found in related crop varieties grown in the choice environment. Once a choice environment is selected, choice plants to be sampled will be identified by their healthy and/or robust growth, and will then be sampled at least 5 at a time by excavating the entire plants plus small root ball including roots and associated soil and any seeds or fruit present on the plant. These will be placed in a cool (4 C environment) for storage and prompt transport back to the lab for extraction of microbes and DNA using methods described herein. Identification of choice environments or ecosystems for bioprospecting of plant associated microbes from either wild plants or crop plants growing in the choice environments or ecosystems follows protocols described herein.

Figure 46:
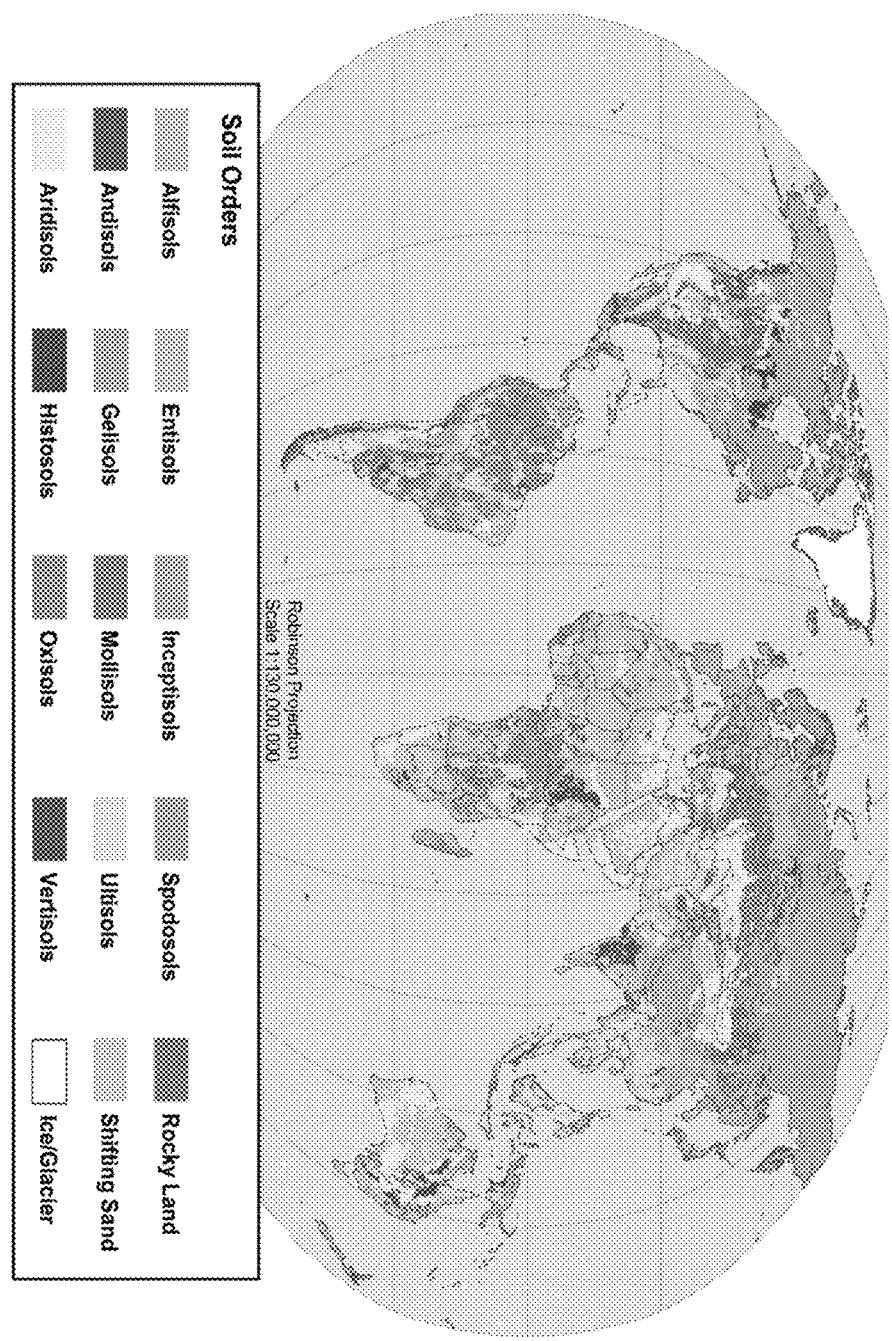
FIG. 46 shows a map of the world showing the distribution of 12 soil orders, plus rocky land, ice/glacier (soil inaccessible) and shifting sand (soil in constant flux).

In one embodiment, the microbe-associated plant is harvested from a soil type different than the normal soil type that the crop plant is grown on, for example from a gelisol (soils with permafrost within 2 m of the surface), for example from a histosol (organic soil), for example from a spodosol (acid forest soils with a subsurface accumulation of metal-humus complexes), for example from an andisol (soils formed in volcanic ash), for example from a oxisol (intensely weathered soils of tropical and subtropical environments), for example from a vertisol (clayey soils with high shrink/swell capacity), for example from an aridisol (CaCO3-containing soils of arid environments with subsurface horizon development), for example from a ultisol (strongly leached soils with a subsurface zone of clay accumulation and <35% base saturation), for example from a mollisol (grassland soils with high base status), for example from an alfisol (moderately leached soils with a subsurface zone of clay accumulation and >35% base saturation), for example from a inceptisol (soils with weakly developed subsurface horizons), for example from a entisol (soils with little or no morphological development). A world map of soil order distribution is shown in FIG. 46.

In a related embodiment, the microbe-associated plant is harvested from a soil type different than the normal soil type that the crop plant is grown on, for example from an acrisol, for example from an albeluvisol, for example from an alisol, for example from an andosol, for example from an anthrosol, for example from an arenosol, for example from a calcisol, for example from a cambisol, for example from a chernozem, for example from a cryosol, for example from a durisol, for example from a ferralsol, for example from a fluvisol, for example from a gleysol, for example from a gypsisol, for example from a histosol, for example from a kastanozem, for example from a leptosol, for example from a lixisol, for example from a luvisol, for example from a nitisol ample from a phaeozem, for example from a planosol, for example from a plinthosol, for example from a podozol, for example from a regosol, for example from a solonchak, for example from a solonetz, for example from an umbrisol, for example from a vertisol.

In another embodiment, the microbe-associated plant is harvested from an ecosystem where the agricultural plant is not normally found, for example a tundra ecosystem as opposed to a temperate agricultural farm, for example from tropical and subtropical moist broadleaf forests (tropical and subtropical, humid), for example from tropical and subtropical dry broadleaf forests (tropical and subtropical, semihumid), for example from tropical and subtropical coniferous forests (tropical and subtropical, semihumid), for example from temperate broadleaf and mixed forests (temperate, humid), for example from temperate coniferous forests (temperate, humid to semihumid), from for example from boreal forests/taiga (subarctic, humid), for example from tropical and subtropical grasslands, savannas, and shrublands (tropical and subtropical, semiarid), for example from temperate grasslands, savannas, and shrublands (temperate, semiarid), for example from flooded grasslands and savannas (temperate to tropical, fresh or brackish water inundated), for example from montane grasslands and shrublands (alpine or montane climate), for example from Mediterranean forests, woodlands, and scrub or sclerophyll forests (temperate warm, semihumid to semiarid with winter rainfall), for example from mangrove forests, and for example from deserts and xeric shrublands (temperate to tropical, arid).

Figure 47:
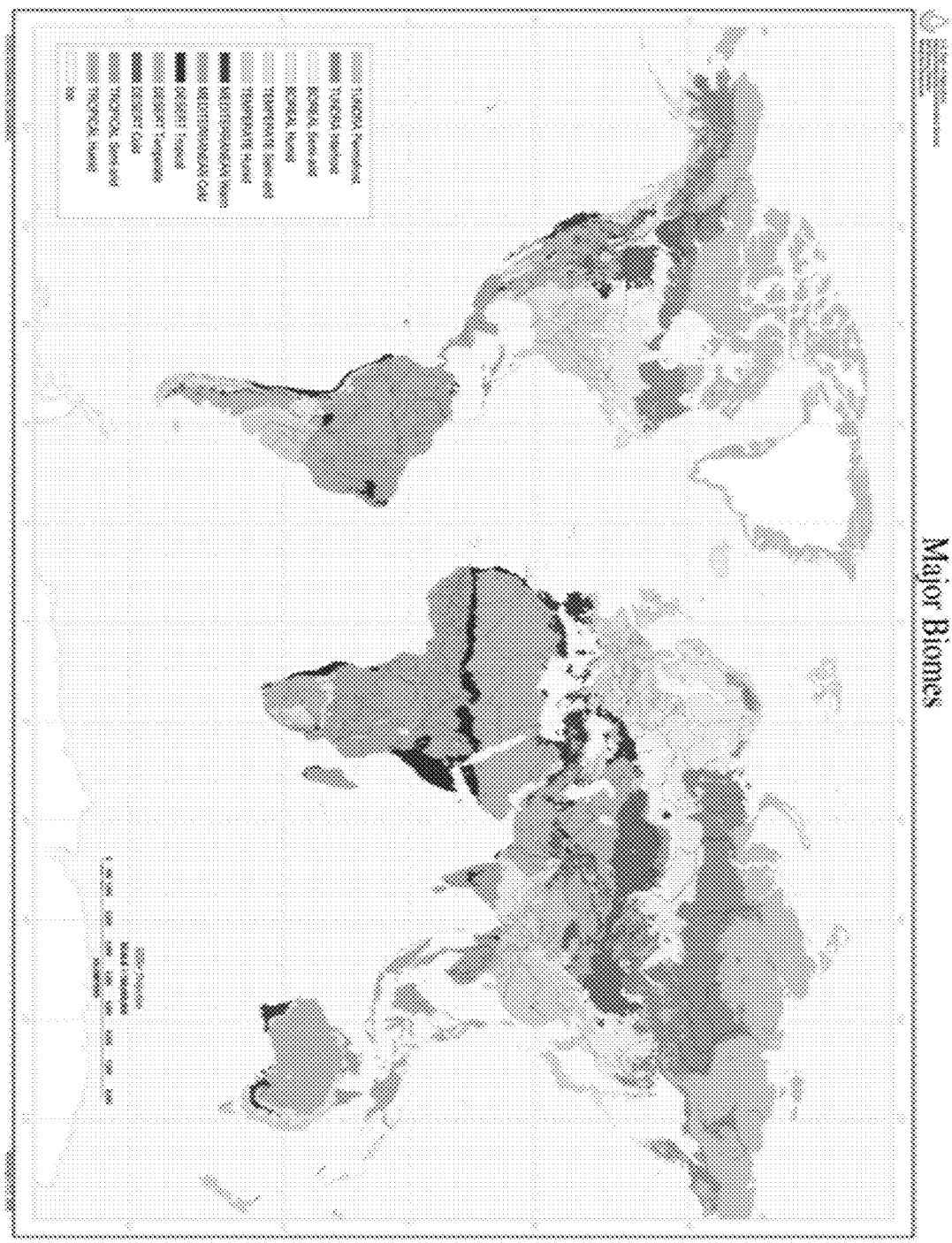
FIG. 47 shows a map of the world showing the distribution of the 14 major biomes.

In a related embodiment, the microbe-associated plant is harvested from a biome where the agricultural plant is not normally found, for example a tundra permafrost biome as opposed to a temperate humid agricultural biome, for example from a tundra interfrost biome, for example from a boreal semi-arid biome, for example from a boreal humid biome, for example from temperate semi-arid biome, for example from temperate humid biome, for example from a Mediterranean warm biome, for example from Mediterranean cold biome, for example from desert tropical biome, for example from desert temperate biome, for example from desert cold biome, for example from tropical semi-arid biome, for example from tropical humid biome, for example from an ice biome. A world map of biome distribution is shown in FIG. 47.

Figure 48:
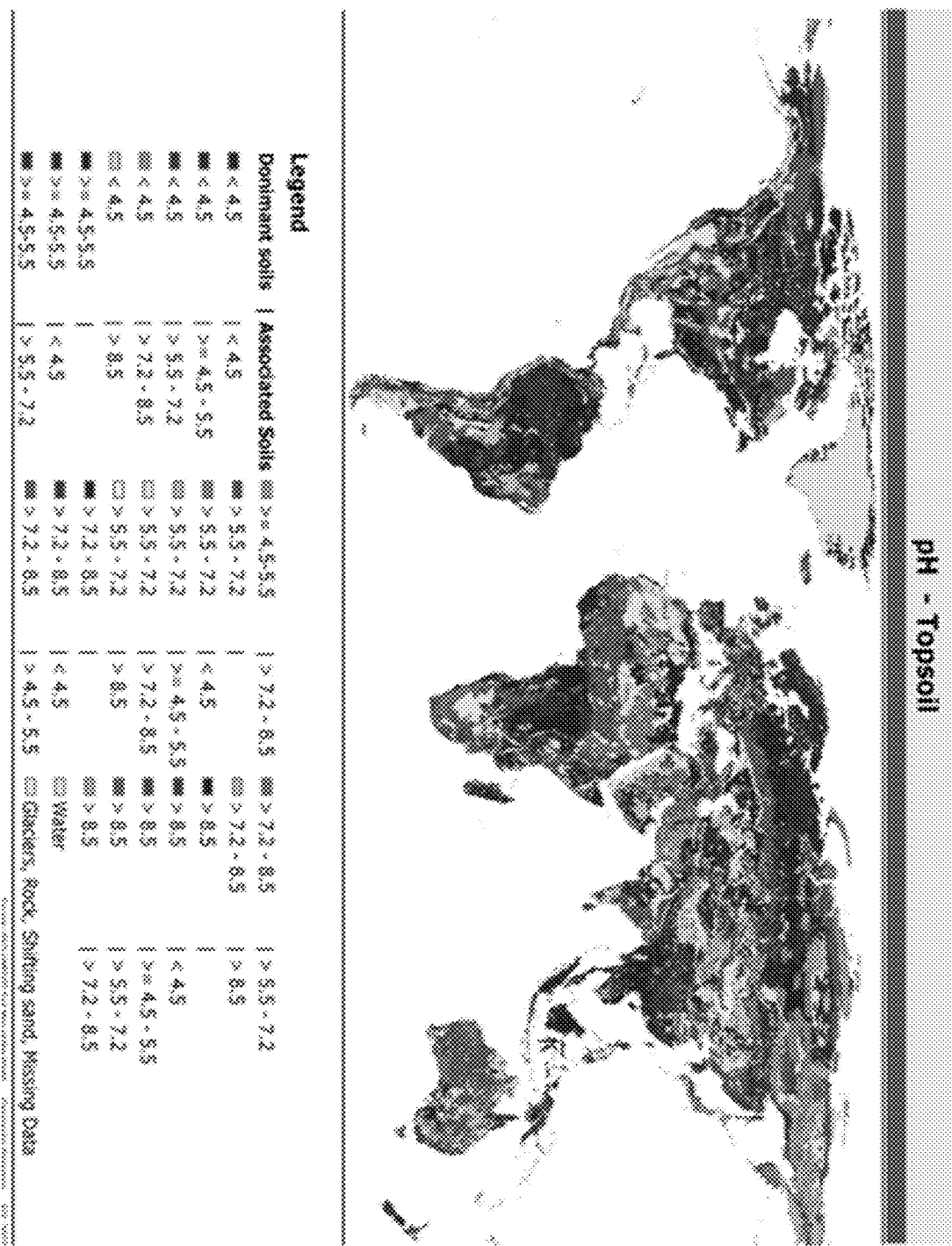
FIG. 48 shows a map of the world showing the distribution of 24 different pH ranges for topsoil (0-30 cm deep).

In another embodiment, the microbe-associated plant is harvested from a soil with an average pH range that is different from the optimal soil pH range of the crop plant, for example the plant may be harvested from an ultra acidic soil (<3.5), from an extreme acid soil (3.5-4.4), from a very strong acid soil (4.5-5.0), from a strong acid soil (5.1-5.5), from a moderate acid soil (5.6-6.0), from an slight acid soil (6.1-6.5), from an neutral soil (6.6-7.3), from an slightly alkaline soil (7.4-7.8), from an moderately alkaline soil (7.9-8.4), from a strongly alkaline soil (8.5-9.0), or from an very strongly alkaline soil (>9.0). A world map of topsoil pH distribution is shown in FIG. 48.

In another embodiment, the microbe-associated plant is harvested from a soil type with different average soil temperatures than the normal soil type that the crop plant is grown on, for example from a pergelic soil (soils at temperatures from −8° C. to −4° C.), for example from a subgelic soil (soils at temperatures from −4° C. to 0° C.), for example from a frigid soil (soils at temperatures from 0° C. to 8° C.), for example from a mesic soil (soils at temperatures from 8° C. to 15° C.), for example from a thermic soil (soils at temperatures from 15° C. to 22° C.), for example from a pergelic soil (soils at temperatures from 22° C. or higher).

In one embodiment, the microbe-associated plant is harvested from an environment with average air temperatures lower than the normal growing temperature of the crop plant, for example 2-5 C colder than average, for example, at least 5-10° C. colder, at least 10-15° C. colder, at least at least 15-20° C. colder, at least 20-25° C. colder, at least 25-30° C. colder, at least 30-35° C. colder, at least 35-40° C. colder, at least 40-45° C. colder, at least 45-50° C. colder, at least 50-55° C. colder or more, when compared with crop plants grown under normal conditions during an average growing season.

In one embodiment, the microbe-associated plant is harvested from an environment with average air temperatures lower than the normal growing temperature of the crop plant, for example 2-55° C. colder than average, for example, at least 5-50° C. colder, at least 15-45° C. colder, at least at least 20-40° C. colder, at least 25-35° C. colder, at least 30° C. colder, when compared with crop plants grown under normal conditions during an average growing season.

In one embodiment, the microbe-associated plant is harvested from an environment with average air temperatures higher than the normal growing temperature of the crop plant, for example 2-5° C. hotter than average, for example, at least 5-10° C. hotter, at least 10-15° C. hotter, at least at least 15-20° C. hotter, at least 20-25° C. hotter, at least 25-30° C. hotter, at least 30-35° C. hotter, at least 35-40° C. hotter, at least 40-45° C. hotter, at least 45-50° C. hotter, at least 50-55° C. hotter or more, when compared with crop plants grown under normal conditions during an average growing season.

In one embodiment, the microbe-associated plant is harvested from an environment with average air temperatures higher than the normal growing temperature of the crop plant, for example 2-55° C. hotter than average, for example, at least 5-50° C. hotter, at least 15-45° C. hotter, at least at least 20-40° C. hotter, at least 25-35° C. hotter, at least 30° C. hotter, when compared with crop plants grown under normal conditions during an average growing season.

In another embodiment, the microbe-associated plant is harvested from an environment with average rainfall lower than the optimal average rainfall received by the crop plant, for example 2-5% less rainfall than average, for example, at least 5-10% less rainfall, at least 10-15% less rainfall, at least 15-20% less rainfall, at least 20-25% less rainfall, at least 25-30% less rainfall, at least 30-35% less rainfall, at least 35-40% less rainfall, at least 40-45% less rainfall, at least 45-50% less rainfall, at least 50-55% less rainfall, at least 55-60% less rainfall, at least 60-65% less rainfall, at least 65-70% less rainfall, at least 70-75% less rainfall, at least 80-85% less rainfall, at least 85-90% less rainfall, at least 90-95% less rainfall, or less, when compared with crop plants grown under normal conditions during an average growing season.

In one embodiment, the microbe-associated plant is harvested from an environment with average rainfall lower than the optimal average rainfall of the crop plant, for example 2-95% less rainfall than average, for example, at least 5-90% less rainfall, at least 10-85% less rainfall, at least 15-80% less rainfall, at least 20-75% less rainfall, at least 25-70% less rainfall, at least 30-65% less rainfall, at least 35-60% less rainfall, at least 40-55% less rainfall, at least 45-50% less rainfall, when compared with crop plants grown under normal conditions during an average growing season.

In one embodiment, the microbe-associated plant is harvested from an environment with average rainfall higher than the optimal average rainfall of the crop plant, for example 2-5% more rainfall than average, for example, at least 5-10% more rainfall, at least 10-15% more rainfall, at least 15-20% more rainfall, at least 20-25% more rainfall, at least 25-30% more rainfall, at least 30-35% more rainfall, at least 35-40% more rainfall, at least 40-45% more rainfall, at least 45-50% more rainfall, at least 50-55% more rainfall, at least 55-60% more rainfall, at least 60-65% more rainfall, at least 65-70% more rainfall, at least 70-75% more rainfall, at least 80-85% more rainfall, at least 85-90% more rainfall, at least 90-95% more rainfall, at least 95-100% more rainfall, or even greater than 100% more rainfall, or even greater than 200% more rainfall, or even greater than 300% more rainfall, or even greater than 400% more rainfall, or even greater than 500% more rainfall, when compared with crop plants grown under normal conditions during an average growing season.

In one embodiment, the microbe-associated plant is harvested from an environment with average rainfall higher than the optimal average rainfall of the crop plant, 2-500% more rainfall than average, 2-400% more rainfall than average, 2-300% more rainfall than average, 2-200% more rainfall than average, 2-95% more rainfall than average, for example, at least 5-90% more rainfall, at least 10-85% more rainfall, at least 15-80% more rainfall, at least 20-75% more rainfall, at least 25-70% more rainfall, at least 30-65% more rainfall, at least 35-60% more rainfall, at least 40-55% more rainfall, at least 45-50% more rainfall, when compared with crop plants grown under normal conditions during an average growing season.

In another embodiment, the microbe-associated plant is harvested from a soil type with different soil moisture classification than the normal soil type that the crop plant is grown on, for example from an aquic soil (soil is saturated with water and virtually free of gaseous oxygen for sufficient periods of time, such that there is evidence of poor aeration), for example from an udic soil (soil moisture is sufficiently high year-round in most years to meet plant requirement), for example from an ustic soil (soil moisture is intermediate between udic and aridic regimes; generally, plant-available moisture during the growing season, but severe periods of drought may occur), for example from an aridic soil (soil is dry for at least half of the growing season and moist for less than 90 consecutive days), for example from a xeric soil (soil moisture regime is found in Mediterranean-type climates, with cool, moist winters and warm, dry summers).

In another embodiment, the microbe-associated plant is harvested from an environment with average rainfall lower than the optimal average rainfall received by the crop plant, for example 2-5% less rainfall than average, for example, at least 5-10% less rainfall, at least 10-15% less rainfall, at least 15-20% less rainfall, at least 20-25% less rainfall, at least 25-30% less rainfall, at least 30-35% less rainfall, at least 35-40% less rainfall, at least 40-45% less rainfall, at least 45-50% less rainfall, at least 50-55% less rainfall, at least 55-60% less rainfall, at least 60-65% less rainfall, at least 65-70% less rainfall, at least 70-75% less rainfall, at least 80-85% less rainfall, at least 85-90% less rainfall, at least 90-95% less rainfall, or less, when compared with crop plants grown under normal conditions during an average growing season.

In one embodiment, the microbe-associated plant is harvested from an environment with average rainfall lower than the optimal average rainfall of the crop plant, for example 2-95% less rainfall than average, for example, at least 5-90% less rainfall, at least 10-85% less rainfall, at least 15-80% less rainfall, at least 20-75% less rainfall, at least 25-70% less rainfall, at least 30-65% less rainfall, at least 35-60% less rainfall, at least 40-55% less rainfall, at least 45-50% less rainfall, when compared with crop plants grown under normal conditions during an average growing season.

In one embodiment, the microbe-associated plant is harvested from an environment with average rainfall higher than the optimal average rainfall of the crop plant, for example 2-5% more rainfall than average, for example, at least 5-10% more rainfall, at least 10-15% more rainfall, at least 15-20% more rainfall, at least 20-25% more rainfall, at least 25-30% more rainfall, at least 30-35% more rainfall, at least 35-40% more rainfall, at least 40-45% more rainfall, at least 45-50% more rainfall, at least 50-55% more rainfall, at least 55-60% more rainfall, at least 60-65% more rainfall, at least 65-70% more rainfall, at least 70-75% more rainfall, at least 80-85% more rainfall, at least 85-90% more rainfall, at least 90-95% more rainfall, at least 95-100% more rainfall, or even greater than 100% more rainfall, or even greater than 200% more rainfall, or even greater than 300% more rainfall, or even greater than 400% more rainfall, or even greater than 500% more rainfall, when compared with crop plants grown under normal conditions during an average growing season.

In one embodiment, the microbe-associated plant is harvested from an environment with average rainfall higher than the optimal average rainfall of the crop plant, 2-500% more rainfall than average, 2-400% more rainfall than average, 2-300% more rainfall than average, 2-200% more rainfall than average, 2-95% more rainfall than average, for example, at least 5-90% more rainfall, at least 10-85% more rainfall, at least 15-80% more rainfall, at least 20-75% more rainfall, at least 25-70% more rainfall, at least 30-65% more rainfall, at least 35-60% more rainfall, at least 40-55% more rainfall, at least 45-50% more rainfall, when compared with crop plants grown under normal conditions during an average growing season.

In another embodiment, the microbe-associated plant is harvested from an agricultural environment with a crop yield lower than the average crop yield expected from the crop plant grown under average cultivation practices on normal agricultural land, for example 2-5% lower yield than average, for example, at least 5-10% lower yield, at least 10-15% lower yield, at least 15-20% lower yield, at least 20-25% lower yield, at least 25-30% lower yield, at least 30-35% lower yield, at least 35-40% lower yield, at least 40-45% lower yield, at least 45-50% lower yield, at least 50-55% lower yield, at least 55-60% lower yield, at least 60-65% lower yield, at least 65-70% lower yield, at least 70-75% lower yield, at least 80-85% lower yield, at least 85-90% lower yield, at least 90-95% lower yield, or less, when compared with crop plants grown under normal conditions during an average growing season.

In a related embodiment, the microbe-associated plant is harvested from an agricultural environment with a crop yield lower than the average crop yield expected from the crop plant grown under average cultivation practices on normal agricultural land, for example 2-95% lower yield than average, for example, at least 5-90% lower yield, at least 10-85% lower yield, at least 15-80% lower yield, at least 20-75% lower yield, at least 25-70% lower yield, at least 30-65% lower yield, at least 35-60% lower yield, at least 40-55% lower yield, at least 45-50% lower yield, when compared with crop plants grown under normal conditions during an average growing season.

In one embodiment, the microbe-associated plant is harvested from an environment with average crop yield higher than the optimal average crop yield of the crop plant, for example 2-5% more yield than average, for example, at least 5-10% more yield, at least 10-15% more yield, at least 15-20% more yield, at least 20-25% more yield, at least 25-30% more yield, at least 30-35% more yield, at least 35-40% more yield, at least 40-45% more yield, at least 45-50% more yield, at least 50-55% more yield, at least 55-60% more yield, at least 60-65% more yield, at least 65-70% more yield, at least 70-75% more yield, at least 80-85% more yield, at least 85-90% more yield, at least 90-95% more yield, at least 95-100% more yield, or even greater than 100% more yield, or even greater than 200% more yield, or even greater than 300% more yield, or even greater than 400% more yield, or even greater than 500% more yield, when compared with crop plants grown under normal conditions during an average growing season.

In a related embodiment, the microbe-associated plant is harvested from an environment with average crop yield higher than the optimal average crop yield of the crop plant, 2-500% more yield than average, 2-400% more yield than average, 2-300% more yield than average, 2-200% more yield than average, 2-95% more yield than average, for example, at least 5-90% more yield, at least 10-85% more yield, at least 15-80% more yield, at least 20-75% more yield, at least 25-70% more yield, at least 30-65% more yield, at least 35-60% more yield, at least 40-55% more yield, at least 45-50% more yield, when compared with crop plants grown under normal conditions during an average growing season.

In another embodiment, the microbe-associated plant is harvested from a environment where soil contains lower total nitrogen than the optimum levels recommended in order to achieve average crop yields for a plant grown under average cultivation practices on normal agricultural land, for example 2-5% less nitrogen than average, for example, at least 5-10% less nitrogen, at least 10-15% less nitrogen, at least 15-20% less nitrogen, at least 20-25% less nitrogen, at least 25-30% less nitrogen, at least 30-35% less nitrogen, at least 35-40% less nitrogen, at least 40-45% less nitrogen, at least 45-50% less nitrogen, at least 50-55% less nitrogen, at least 55-60% less nitrogen, at least 60-65% less nitrogen, at least 65-70% less nitrogen, at least 70-75% less nitrogen, at least 80-85% less nitrogen, at least 85-90% less nitrogen, at least 90-95% less nitrogen, or less, when compared with crop plants grown under normal conditions during an average growing season.

In a related embodiment, the microbe-associated plant is harvested from a environment where soil contains lower total nitrogen than the optimum levels recommended in order to achieve average crop yields for a plant grown under average cultivation practices on normal agricultural land, for example 2-95% less nitrogen than average, for example, at least 5-90% less nitrogen, at least 10-85% less nitrogen, at least 15-80% less nitrogen, at least 20-75% less nitrogen, at least 25-70% less nitrogen, at least 30-65% less nitrogen, at least 35-60% less nitrogen, at least 40-55% less nitrogen, at least 45-50% less nitrogen, when compared with crop plants grown under normal conditions during an average growing season.

In another embodiment, the microbe-associated plant is harvested from a environment where soil contains higher total nitrogen than the optimum levels recommended in order to achieve average crop yields for a plant grown under average cultivation practices on normal agricultural land, for example 2-5% more nitrogen than average, for example, at least 5-10% more nitrogen, at least 10-15% more nitrogen, at least 15-20% more nitrogen, at least 20-25% more nitrogen, at least 25-30% more nitrogen, at least 30-35% more nitrogen, at least 35-40% more nitrogen, at least 40-45% more nitrogen, at least 45-50% more nitrogen, at least 50-55% more nitrogen, at least 55-60% more nitrogen, at least 60-65% more nitrogen, at least 65-70% more nitrogen, at least 70-75% more nitrogen, at least 80-85% more nitrogen, at least 85-90% more nitrogen, at least 90-95% more nitrogen, at least 95-100% more nitrogen, or even greater than 100% more nitrogen, or even greater than 200% more nitrogen, or even greater than 300% more nitrogen, or even greater than 400% more nitrogen, or even greater than 500% more nitrogen, when compared with crop plants grown under normal conditions during an average growing season.

In a related embodiment, the microbe-associated plant is harvested from a environment where soil contains higher total nitrogen than the optimum levels recommended in order to achieve average crop yields for a plant grown under average cultivation practices on normal agricultural land, 2-500% more nitrogen than average, 2-400% more nitrogen than average, 2-300% more nitrogen than average, 2-200% more nitrogen than average, 2-95% more nitrogen than average, for example, at least 5-90% more nitrogen, at least 10-85% more nitrogen, at least 15-80% more nitrogen, at least 20-75% more nitrogen, at least 25-70% more nitrogen, at least 30-65% more nitrogen, at least 35-60% more nitrogen, at least 40-55% more nitrogen, at least 45-50% more nitrogen, when compared with crop plants grown under normal conditions during an average growing season.

In another embodiment, the microbe-associated plant is harvested from a environment where soil contains lower total phosphorus than the optimum levels recommended in order to achieve average crop yields for a plant grown under average cultivation practices on normal agricultural land, for example 2-5% less phosphorus than average, for example, at least 5-10% less phosphorus, at least 10-15% less phosphorus, at least 15-20% less phosphorus, at least 20-25% less phosphorus, at least 25-30% less phosphorus, at least 30-35% less phosphorus, at least 35-40% less phosphorus, at least 40-45% less phosphorus, at least 45-50% less phosphorus, at least 50-55% less phosphorus, at least 55-60% less phosphorus, at least 60-65% less phosphorus, at least 65-70% less phosphorus, at least 70-75% less phosphorus, at least 80-85% less phosphorus, at least 85-90% less phosphorus, at least 90-95% less phosphorus, or less, when compared with crop plants grown under normal conditions during an average growing season.

In a related embodiment, the microbe-associated plant is harvested from a environment where soil contains lower total phosphorus than the optimum levels recommended in order to achieve average crop yields for a plant grown under average cultivation practices on normal agricultural land, for example 2-95% less phosphorus than average, for example, at least 5-90% less phosphorus, at least 10-85% less phosphorus, at least 15-80% less phosphorus, at least 20-75% less phosphorus, at least 25-70% less phosphorus, at least 30-65% less phosphorus, at least 35-60% less phosphorus, at least 40-55% less phosphorus, at least 45-50% less phosphorus, when compared with crop plants grown under normal conditions during an average growing season.

In another embodiment, the microbe-associated plant is harvested from a environment where soil contains higher total phosphorus than the optimum levels recommended in order to achieve average crop yields for a plant grown under average cultivation practices on normal agricultural land, for example 2-5% more phosphorus than average, for example, at least 5-10% more phosphorus, at least 10-15% more phosphorus, at least 15-20% more phosphorus, at least 20-25% more phosphorus, at least 25-30% more phosphorus, at least 30-35% more phosphorus, at least 35-40% more phosphorus, at least 40-45% more phosphorus, at least 45-50% more phosphorus, at least 50-55% more phosphorus, at least 55-60% more phosphorus, at least 60-65% more phosphorus, at least 65-70% more phosphorus, at least 70-75% more phosphorus, at least 80-85% more phosphorus, at least 85-90% more phosphorus, at least 90-95% more phosphorus, at least 95-100% more phosphorus, or even greater than 100% more phosphorus, or even greater than 200% more phosphorus, or even greater than 300% more phosphorus, or even greater than 400% more phosphorus, or even greater than 500% more phosphorus, when compared with crop plants grown under normal conditions during an average growing season.

In a related embodiment, the microbe-associated plant is harvested from a environment where soil contains higher total phosphorus than the optimum levels recommended in order to achieve average crop yields for a plant grown under average cultivation practices on normal agricultural land, 2-500% more phosphorus than average, 2-400% more phosphorus than average, 2-300% more phosphorus than average, 2-200% more phosphorus than average, 2-95% more phosphorus than average, for example, at least 5-90% more phosphorus, at least 10-85% more phosphorus, at least 15-80% more phosphorus, at least 20-75% more phosphorus, at least 25-70% more phosphorus, at least 30-65% more phosphorus, at least 35-60% more phosphorus, at least 40-55% more phosphorus, at least 45-50% more phosphorus, when compared with crop plants grown under normal conditions during an average growing season.

In another embodiment, the microbe-associated plant is harvested from a environment where soil contains lower total potassium than the optimum levels recommended in order to achieve average crop yields for a plant grown under average cultivation practices on normal agricultural land, for example 2-5% less potassium than average, for example, at least 5-10% less potassium, at least 10-15% less potassium, at least 15-20% less potassium, at least 20-25% less potassium, at least 25-30% less potassium, at least 30-35% less potassium, at least 35-40% less potassium, at least 40-45% less potassium, at least 45-50% less potassium, at least 50-55% less potassium, at least 55-60% less potassium, at least 60-65% less potassium, at least 65-70% less potassium, at least 70-75% less potassium, at least 80-85% less potassium, at least 85-90% less potassium, at least 90-95% less potassium, or less, when compared with crop plants grown under normal conditions during an average growing season.

In a related embodiment, the microbe-associated plant is harvested from a environment where soil contains lower total potassium than the optimum levels recommended in order to achieve average crop yields for a plant grown under average cultivation practices on normal agricultural land, for example 2-95% less potassium than average, for example, at least 5-90% less potassium, at least 10-85% less potassium, at least 15-80% less potassium, at least 20-75% less potassium, at least 25-70% less potassium, at least 30-65% less potassium, at least 35-60% less potassium, at least 40-55% less potassium, at least 45-50% less potassium, when compared with crop plants grown under normal conditions during an average growing season.

In another embodiment, the microbe-associated plant is harvested from a environment where soil contains higher total potassium than the optimum levels recommended in order to achieve average crop yields for a plant grown under average cultivation practices on normal agricultural land, for example 2-5% more potassium than average, for example, at least 5-10% more potassium, at least 10-15% more potassium, at least 15-20% more potassium, at least 20-25% more potassium, at least 25-30% more potassium, at least 30-35% more potassium, at least 35-40% more potassium, at least 40-45% more potassium, at least 45-50% more potassium, at least 50-55% more potassium, at least 55-60% more potassium, at least 60-65% more potassium, at least 65-70% more potassium, at least 70-75% more potassium, at least 80-85% more potassium, at least 85-90% more potassium, at least 90-95% more potassium, at least 95-100% more potassium, or even greater than 100% more potassium, or even greater than 200% more potassium, or even greater than 300% more potassium, or even greater than 400% more potassium, or even greater than 500% more potassium, when compared with crop plants grown under normal conditions during an average growing season.

In a related embodiment, the microbe-associated plant is harvested from a environment where soil contains higher total potassium than the optimum levels recommended in order to achieve average crop yields for a plant grown under average cultivation practices on normal agricultural land, 2-500% more potassium than average, 2-400% more potassium than average, 2-300% more potassium than average, 2-200% more potassium than average, 2-95% more potassium than average, for example, at least 5-90% more potassium, at least 10-85% more potassium, at least 15-80% more potassium, at least 20-75% more potassium, at least 25-70% more potassium, at least 30-65% more potassium, at least 35-60% more potassium, at least 40-55% more potassium, at least 45-50% more potassium, when compared with crop plants grown under normal conditions during an average growing season.

In another embodiment, the microbe-associated plant is harvested from a environment where soil contains lower total sulfur than the optimum levels recommended in order to achieve average crop yields for a plant grown under average cultivation practices on normal agricultural land, for example 2-5% less sulfur than average, for example, at least 5-10% less sulfur, at least 10-15% less sulfur, at least 15-20% less sulfur, at least 20-25% less sulfur, at least 25-30% less sulfur, at least 30-35% less sulfur, at least 35-40% less sulfur, at least 40-45% less sulfur, at least 45-50% less sulfur, at least 50-55% less sulfur, at least 55-60% less sulfur, at least 60-65% less sulfur, at least 65-70% less sulfur, at least 70-75% less sulfur, at least 80-85% less sulfur, at least 85-90% less sulfur, at least 90-95% less sulfur, or less, when compared with crop plants grown under normal conditions during an average growing season.

In a related embodiment, the microbe-associated plant is harvested from a environment where soil contains lower total sulfur than the optimum levels recommended in order to achieve average crop yields for a plant grown under average cultivation practices on normal agricultural land, for example 2-95% less sulfur than average, for example, at least 5-90% less sulfur, at least 10-85% less sulfur, at least 15-80% less sulfur, at least 20-75% less sulfur, at least 25-70% less sulfur, at least 30-65% less sulfur, at least 35-60% less sulfur, at least 40-55% less sulfur, at least 45-50% less sulfur, when compared with crop plants grown under normal conditions during an average growing season.

In another embodiment, the microbe-associated plant is harvested from a environment where soil contains higher total sulfur than the optimum levels recommended in order to achieve average crop yields for a plant grown under average cultivation practices on normal agricultural land, for example 2-5% more sulfur than average, for example, at least 5-10% more sulfur, at least 10-15% more sulfur, at least 15-20% more sulfur, at least 20-25% more sulfur, at least 25-30% more sulfur, at least 30-35% more sulfur, at least 35-40% more sulfur, at least 40-45% more sulfur, at least 45-50% more sulfur, at least 50-55% more sulfur, at least 55-60% more sulfur, at least 60-65% more sulfur, at least 65-70% more sulfur, at least 70-75% more sulfur, at least 80-85% more sulfur, at least 85-90% more sulfur, at least 90-95% more sulfur, at least 95-100% more sulfur, or even greater than 100% more sulfur, or even greater than 200% more sulfur, or even greater than 300% more sulfur, or even greater than 400% more sulfur, or even greater than 500% more sulfur, when compared with crop plants grown under normal conditions during an average growing season.

In a related embodiment, the microbe-associated plant is harvested from a environment where soil contains higher total sulfur than the optimum levels recommended in order to achieve average crop yields for a plant grown under average cultivation practices on normal agricultural land, 2-500% more sulfur than average, 2-400% more sulfur than average, 2-300% more sulfur than average, 2-200% more sulfur than average, 2-95% more sulfur than average, for example, at least 5-90% more sulfur, at least 10-85% more sulfur, at least 15-80% more sulfur, at least 20-75% more sulfur, at least 25-70% more sulfur, at least 30-65% more sulfur, at least 35-60% more sulfur, at least 40-55% more sulfur, at least 45-50% more sulfur, when compared with crop plants grown under normal conditions during an average growing season.

In another embodiment, the microbe-associated plant is harvested from a environment where soil contains lower total calcium than the optimum levels recommended in order to achieve average crop yields for a plant grown under average cultivation practices on normal agricultural land, for example 2-5% less calcium than average, for example, at least 5-10% less calcium, at least 10-15% less calcium, at least 15-20% less calcium, at least 20-25% less calcium, at least 25-30% less calcium, at least 30-35% less calcium, at least 35-40% less calcium, at least 40-45% less calcium, at least 45-50% less calcium, at least 50-55% less calcium, at least 55-60% less calcium, at least 60-65% less calcium, at least 65-70% less calcium, at least 70-75% less calcium, at least 80-85% less calcium, at least 85-90% less calcium, at least 90-95% less calcium, or less, when compared with crop plants grown under normal conditions during an average growing season.

In a related embodiment, the microbe-associated plant is harvested from a environment where soil contains lower total calcium than the optimum levels recommended in order to achieve average crop yields for a plant grown under average cultivation practices on normal agricultural land, for example 2-95% less calcium than average, for example, at least 5-90% less calcium, at least 10-85% less calcium, at least 15-80% less calcium, at least 20-75% less calcium, at least 25-70% less calcium, at least 30-65% less calcium, at least 35-60% less calcium, at least 40-55% less calcium, at least 45-50% less calcium, when compared with crop plants grown under normal conditions during an average growing season.

In another embodiment, the microbe-associated plant is harvested from a environment where soil contains higher total calcium than the optimum levels recommended in order to achieve average crop yields for a plant grown under average cultivation practices on normal agricultural land, for example 2-5% more calcium than average, for example, at least 5-10% more calcium, at least 10-15% more calcium, at least 15-20% more calcium, at least 20-25% more calcium, at least 25-30% more calcium, at least 30-35% more calcium, at least 35-40% more calcium, at least 40-45% more calcium, at least 45-50% more calcium, at least 50-55% more calcium, at least 55-60% more calcium, at least 60-65% more calcium, at least 65-70% more calcium, at least 70-75% more calcium, at least 80-85% more calcium, at least 85-90% more calcium, at least 90-95% more calcium, at least 95-100% more calcium, or even greater than 100% more calcium, or even greater than 200% more calcium, or even greater than 300% more calcium, or even greater than 400% more calcium, or even greater than 500% more calcium, when compared with crop plants grown under normal conditions during an average growing season.

In a related embodiment, the microbe-associated plant is harvested from a environment where soil contains higher total calcium than the optimum levels recommended in order to achieve average crop yields for a plant grown under average cultivation practices on normal agricultural land, 2-500% more calcium than average, 2-400% more calcium than average, 2-300% more calcium than average, 2-200% more calcium than average, 2-95% more calcium than average, for example, at least 5-90% more calcium, at least 10-85% more calcium, at least 15-80% more calcium, at least 20-75% more calcium, at least 25-70% more calcium, at least 30-65% more calcium, at least 35-60% more calcium, at least 40-55% more calcium, at least 45-50% more calcium, when compared with crop plants grown under normal conditions during an average growing season.

In another embodiment, the microbe-associated plant is harvested from a environment where soil contains lower total magnesium than the optimum levels recommended in order to achieve average crop yields for a plant grown under average cultivation practices on normal agricultural land, for example 2-5% less magnesium than average, for example, at least 5-10% less magnesium, at least 10-15% less magnesium, at least 15-20% less magnesium, at least 20-25% less magnesium, at least 25-30% less magnesium, at least 30-35% less magnesium, at least 35-40% less magnesium, at least 40-45% less magnesium, at least 45-50% less magnesium, at least 50-55% less magnesium, at least 55-60% less magnesium, at least 60-65% less magnesium, at least 65-70% less magnesium, at least 70-75% less magnesium, at least 80-85% less magnesium, at least 85-90% less magnesium, at least 90-95% less magnesium, or less, when compared with crop plants grown under normal conditions during an average growing season.

In a related embodiment, the microbe-associated plant is harvested from a environment where soil contains lower total magnesium than the optimum levels recommended in order to achieve average crop yields for a plant grown under average cultivation practices on normal agricultural land, for example 2-95% less magnesium than average, for example, at least 5-90% less magnesium, at least 10-85% less magnesium, at least 15-80% less magnesium, at least 20-75% less magnesium, at least 25-70% less magnesium, at least 30-65% less magnesium, at least 35-60% less magnesium, at least 40-55% less magnesium, at least 45-50% less magnesium, when compared with crop plants grown under normal conditions during an average growing season.

In another embodiment, the microbe-associated plant is harvested from a environment where soil contains higher total sodium chloride (salt) than the optimum levels recommended in order to achieve average crop yields for a plant grown under average cultivation practices on normal agricultural land, for example 2-5% more salt than average, for example, at least 5-10% more salt, at least 10-15% more salt, at least 15-20% more salt, at least 20-25% more salt, at least 25-30% more salt, at least 30-35% more salt, at least 35-40% more salt, at least 40-45% more salt, at least 45-50% more salt, at least 50-55% more salt, at least 55-60% more salt, at least 60-65% more salt, at least 65-70% more salt, at least 70-75% more salt, at least 80-85% more salt, at least 85-90% more salt, at least 90-95% more salt, at least 95-100% more salt, or even greater than 100% more salt, or even greater than 200% more salt, or even greater than 300% more salt, or even greater than 400% more salt, or even greater than 500% more salt, when compared with crop plants grown under normal conditions during an average growing season.

In a related embodiment, the microbe-associated plant is harvested from a environment where soil contains higher total sodium chloride (salt) than the optimum levels recommended in order to achieve average crop yields for a plant grown under average cultivation practices on normal agricultural land, 2-500% more salt than average, 2-400% more salt than average, 2-300% more salt than average, 2-200% more salt than average, 2-95% more salt than average, for example, at least 5-90% more salt, at least 10-85% more salt, at least 15-80% more salt, at least 20-75% more salt, at least 25-70% more salt, at least 30-65% more salt, at least 35-60% more salt, at least 40-55% more salt, at least 45-50% more salt, when compared with crop plants grown under normal conditions during an average growing season.

Microbes Capable of Altering the Metabolome, Epigenome, or Transcriptome of Plants The microbes useful for the invention can also be classified according to the changes conferred upon the plant. For example, the microbe can alter the hormone status or levels of hormone production in the plant, which in turn can affect many physiological parameters, including flowering time, water efficiency, apical dominance and/or lateral shoot branching, increase in root hair, and alteration in fruit ripening. The microbe may also introduce other changes to the plant, including biochemical, metabolomic, proteomic, genomic, epigenomic and/or transcriptomic profiles of microbe-associated plants can be compared with reference agricultural plants under the same conditions.

Metabolomic differences between the plants can be detected using methods known in the art. For example, a biological sample (whole tissue, exudate, phloem sap, xylem sap, root exudate, etc.) from the microbe-associated and reference agricultural plants can be analyzed essentially as described in Fiehn et al., (2000) Nature Biotechnol., 18, 1157-1161, or Roessner et al., (2001) Plant Cell, 13, 11-29. Such metabolomic methods can be used to detect differences in levels in hormone, nutrients, secondary metabolites, root exudates, phloem sap content, xylem sap content, heavy metal content, and the like. Such methods are also useful for detecting alterations in microbial content and status; for example, the presence and levels of bacterial/fungal signaling molecules (e.g., autoinducers and pheromones), which can indicate the status of group-based behavior of microbes based on, for example, population density (see, for example Daniels et al., (2006). PNAS 103: 14965-14970. Eberhard et al., (1981). Biochemistry 20 (9): 2444-2449). Transcriptome analysis (reviewed, for example, in Usadel & Fernie, (2013). Front Plant Sci. 4:48) of microbe-associated and reference agricultural plants can also be performed to detect changes in expression of at least one transcript, or a set or network of genes upon microbe association. Similarly, epigenetic changes can be detected using methylated DNA immunoprecipitation followed by high-throughput sequencing (Vining et al., (2013) BMC Plant Biol. 13:92).

Selection of Microbes Conferring Beneficial Traits

The present invention contemplates inoculation of plants with microbes. As described earlier, the microbes can be derived from many different plants species, from different parts of the plants, and from plants isolated across different environments. Once a microbe is isolated, it can be tested for its ability to confer a beneficial trait. Numerous tests can be performed both in vitro and in vivo to assess what benefits, if any, are conferred upon the plant. In one embodiment, a microbe is tested in vitro for an activity selected from the group consisting of: liberation of complexed phosphates, liberation of complexed iron (e.g., through secretion of siderophores), production of phytohormones, production of antibacterial compounds, production of antifungal compounds, production of insecticidal compounds, production of nematicidal compounds, production and/or secretion of ACC deaminase, production and/or secretion of acetoin, production and/or secretion of pectinase, production and/or secretion of cellulase, and production and/or secretion of RNAse. Exemplary in vitro methods for the above can be found in the Examples sections below.

It is noted that the initial test for the activities listed above can also be performed using a mixture of microbes, for example, a community of microbes isolated from a single plant. A positive activity readout using such mixture can be followed with the isolation of individual microbes within that population and repeating the in vitro tests for the activities to isolate the microbe responsible for the particular activity. Once validated using a single microbe isolate, then the plant can be inoculated with a microbe, and the test performed in vivo, either in growth chamber or greenhouse conditions, and comparing with a control plant that was not inoculated with the microbe.

Preparation of Microbes & Formulations

It is recommendable to safeguard conditions which are favorable to the microorganisms used. The microorganisms are usually applied in suspension at a suitable concentration. The preparation of microbes can be an aqueous solution, an oil-in-water emulsion or water-in-oil emulsion containing a minimum concentration of a microbe. Microbes may be present as live cells, viable cells, spores, or mycelia. Typically, the concentration is at least $10^4$ CFU/ml, for example at least $3 \times 10^4$ CFU/mL, at least $10^5$ CFU/mL, at least $3 \times 10^5$ CFU/mL, at least $10^6$ CFU/mL, at least $3 \times 10^6$ CFU/mL, at least $10^7$, at least $3 \times 10^7$ CFU/mL, at least $10^8$ CFU/mL, $10^9$ CFU/mL or more. In one embodiment, the preparation is a solution containing a microbe at a concentration between about $10^5$ CFU/mL and about $10^9$ CFU/mL. In another embodiment, the preparation contains a microbe at a concentration between about $10^6$ CFU/mL and about $10^8$ CFU/mL.

The synthetic preparation can also contain any number of other components. In one embodiment, the synthetic preparation may contain growth media or constituents required for the growth and propagation of the microbe. Examples of growth media that can be employed include those listed, for example, in: Hurst, Christon J., et al. Manual of environmental microbiology. No. Ed. 3. ASM press, 2007; DIFCO laboratories (Detroit, Mich.). Difco™ & BBL™ Manual: Manual of Microbiological Culture Media, 2nd Ed. Difco laboratories, 2009; Jones, Kenneth L. Journal of bacteriology 57.2 (1949): 141; Liu, Dong, et al. Proceedings of the National Academy of Sciences 91.5 (1994): 1888-1892; and Atlas, Ronald M. Handbook of microbiological media. Vol. 1. CRC press, 2004, each of which is incorporated by reference in its entirety. In one embodiment, the growth medium is selected from the group provided in Table 6.

The synthetic preparation can be of a defined pH range. In one embodiment, the pH of the preparation can be between pH 5.5-6.0, pH 5.75-6.25, pH 6.0-6.5, pH 6.25-6.75, pH 6.5-7.0, pH 6.75-7.25, and pH 7.0-7.5. The pH of the medium can be adjusted using any biologically compatible buffering agent.

The synthetic preparation can also comprise a carrier, such as diatomaceous earth, clay, zeolite, or chitin, which act to complex with chemical agents, such as control agents. The synthetic preparation can also comprise an adherent. Such agents are useful for combining the microbes of the invention with carriers that can contain other compounds (e.g., control agents that are not biologic), to yield a coating composition. Such compositions help create coatings around the plant part to maintain contact between the microbe and other agents with the plant or plant part. In one embodiment, adherents are selected from the group consisting of: alginate, gums, starches, lecithins, formononetin, polyvinyl alcohol, alkali formononetinate, hesperetin, polyvinyl acetate, cephalins, Gum Arabic, Xanthan Gum, Mineral Oil, Polyethylene Glycol (PEG), Polyvinyl pyrrolidone (PVP), Arabino-galactan, Methyl Cellulose, PEG 400, Chitosan, Polyacrylamide, Polyacrylate, Polyacrylonitrile, Glycerol, Triethylene glycol, Vinyl Acetate, Gellan Gum, Polystyrene, Polyvinyl, Carboxymethyl cellulose, Gum Ghatti, and polyoxyethylene-polyoxybutylene block copolymers. Other examples of adherent compositions that can be used in the synthetic preparation include those described in EP 0818135, CA 1229497, WO 2013090628, EP 0192342, WO 2008103422 and CA 1041788, each of which is incorporated by reference in its entirety.

The synthetic preparation can also contain one or more reagents that promote internalization of the microbe into the plant, and can include any one of the following classes of compounds: a surfactant, an abrasive, an agent promoting stomatal opening, an osmoticum, and a plant signaling molecule.

Non-limiting examples of surfactants include nitrogen-surfactant blends such as Prefer 28 (Cenex), Surf-N(US), Inhance (Brandt), P-28 (Wilfarm) and Patrol (Helena); esterified seed oils include Sun-It II (AmCy), MSO (UAP), Scoil (Agsco), Hasten (Wilfarm) and Mes-100 (Drexel); and organo-silicone surfactants include Silwet L77 (UAP), Silikin (Terra), Dyne-Amic (Helena), Kinetic (Helena), Sylgard 309 (Wilbur-Ellis) and Century (Precision). In one embodiment, the surfactant is present at a concentration of between 0.01% v/v to 10% v/v. In another embodiment, the surfactant is present at a concentration of between 0.1% v/v to 1% v/v.

The synthetic preparation of a defined osmolality can also be used. In one embodiment, the synthetic preparation has an osmolality of less than about 100 mOsm, for example less than about 75 mOsm, less than about 50 mOsm, or less than about 25 mOsm. In another embodiment, the synthetic preparation has an osmolality of at least 250 mOsm, for example at least 300 mOsm, at least 400 mOsm, at least 500 mOsm, at least 600 mOsm, at least 700 mOsm, at least 800 mOsm, 900 mOsm or greater. The osmolality of the preparation can be adjusted by addition of an osmoticum: the osmoticum can be any commonly used osmoticum, and can selected from the group consisting of: mannitol, sorbitol, NaCl, KCl, $CaCl_2$, $MgSO_4$, sucrose, or any combination thereof.

Also contemplated herein is the use of an agent and/or condition that promotes stomatal opening, in order to facilitate entry of the microbe into the plant. Agents and conditions known to induce stomatal opening include light, particularly blue light and red light (Reviewed in, for example, Schroeder et al., Annu. Rev. Plant Physiol. Plant Mol. Biol. 2001. 52:627-58). In addition, compounds which promote stomatal opening, or inhibit stomatal closing, such as Cyclosporin A, linolenic acid, arachidonic acid, coronatine and cytochalasin D.

The microbe can be obtained from growth in culture, for example, using synthetic growth medium. In addition, the microbe can be cultured on solid media, for example on petri dishes, scraped off and suspended into the preparation. Microbes at different growth phases can be used. For example, microbes at lag phase, early-log phase, mid-log phase, late-log phase, stationary phase, early death phase, or death phase can be used.

For certain microbes that exist as mycelia or mycelia-like structures, pre-treatment of the microbes with enzymes (including, but not limited to, driselase, gluculase, cellulase, beta-glucanase, lysozyme, zymolyase) can be used to generate protoplasts in order to provide a suspension of microbes. After generation of protoplasts, the microbes can be allowed to partially regenerate the cell walls by leaving the protoplasts in a growth medium or solution with relatively high osmolarity for a short time (typically less than about 12 hours at room temperature) to prevent bursting of protoplasts.

Contacting the Plant with the Preparation of Microbes

In general terms, provided herein are methods of producing an agricultural seed with an altered composition of microbes. The seed generated according to the present invention contains the microbe on and/or in the seed, and is generated by the following steps. First, a preparation of an isolated microbe is provided. The microbial preparation is then contacted with the plant. The plants are then provided with conditions such that the plant generates an agricultural seed, and the agricultural seed, which contain the microbes on and/or in the seed, are collected. The microbes contained within the seed are viably incorporated on and/or in the seed.

In preferred embodiments, the microbes are contacted with the plant by administering them prior to, during, or just after flowering in order to provide the microbes with improved access to plant reproductive tissues. In some such embodiments, the microorganisms are e.g., sprayed, dusted onto, or otherwise applied to flowering plants such that the microbes reliably enter the plants and colonize the emerging seeds. The microorganisms may also be applied by specific instruments to the flower, for example, by a spatula, a syringe or an inoculating loop.

In addition to aqueous suspensions, the microbial preparations of the invention can be applied in a dry formulation using talc or some other particulate carrier. In such cases, the microbial preparation can be dried lyophilized in a manner preserving viability of the microbe (for example by using cryopreservants and/or protective sugars), and be present at a level of from about at least $10^2$ CFU per gram of dry formulation, for example, at least $10^3$ CFU per gram, at least $10^4$ CFU per gram, at least $10^5$ CFU per gram, at least $10^6$ CFU per gram, at least $10^7$ CFU per gram, at least $10^8$ CFU per gram, or more. Such dry compositions can be applied by dusting, or coating a plant, a plant field, or seed. In use, plants or seeds are treated with the compositions described herein by simply contacting one or more portions of the plant or seed. Additionally, the seeds or tubers can be submerged in the aqueous composition and then planted and allowed to grow into a protected plant. Furthermore, the soil around the plant or seed can be treated as well. When the plant to be treated is a tree, the composition can be introduced into the vascular system of the tree by conventional methods.

Also contemplated herein are methods of inoculating a plant with a plurality of microbes. The method can be performed in a manner similar to those described above for single microbe inoculation. Multiple microbes can be prepared in a single preparation which is contacted with the plant. Alternatively, a plant can be contacted sequentially with a first preparation containing the first microbe, then a second preparation containing the second microbe. In some other cases, the plant may be contacted with a first preparation of first microbes. The seeds of the plant are then collected, and allowed to germinate. The resulting progeny is then inoculated with a second preparation of second microbes, or a preparation containing the multiple microbes (e.g., the first and second microbes). The seeds of the inoculated progeny are then collected and tested for the presence of multiple microbes on and/or in the seed.

Where multiple microbes are inoculated onto a single plant, any or all of the microbes may be capable of conferring a trait onto the host plant. In some cases, all of the microbes are capable of conferring a trait onto the host plant. The trait conferred by each of the microbes may be the same (e.g., both improve the host plant's tolerance to a particular biotic stress), or may be distinct (e.g., one improves the host plant's tolerance to drought, while another improves phosphate utilization). In other cases the conferred trait may be the result of interactions between the microbes.

As described herein, a plant is contacted with a preparation of microbes. The preparation of microbes can be applied to the plant using several different means. For example, the preparation can be sprayed to the entire plant, or part of the plant (e.g., roots, shoots, leaves, above-ground tissues, or parts of the plant including the flowers or buds). In one embodiment, the above-ground tissues of the plant are sprayed with the suspension. In another embodiment, the areas around the bud and flowers of a plant are sprayed with the microbial suspension. In still another embodiment, the meristem tissues and surrounding areas of a plant are sprayed with the microbial suspension.

A suspension or paste of microbes can be brushed or painted onto the whole plant or particular tissue/organs of the plant. In one embodiment, a suspension or paste of microbes is brushed onto any one of the tissues/organs and surrounding parts selected from the group consisting of the flower, bud, and meristematic tissue.

A plant can also be submerged into a preparation containing the microbes (e.g., a microbial suspension). For example, the entire plant, or part of the plant (e.g., roots, shoots, leaves, above-ground tissues, or parts of the plant including the flowers or buds) can be submerged into a microbial suspension for a defined period of time. In one embodiment, a plant or a portion thereof is submerged for a period of at least 5 minutes, for example at least 10 minutes, at least 15 minutes, at least 30 minutes, at least 1 hour, at least 2 hours, at least 5 hours or more. In another embodiment, the plant, or a portion thereof, is submerged in the microbial suspension for no longer than 48 hours, for example, no longer than 24 hours, no longer than 12 hours, or no longer than 6 hours.

As described herein, a plant can be contacted with the microbial preparation at defined developmental stages. For example, the microbial preparation can be contacted with the plant at any one of the stages selected from the group consisting of the imbibition, germination stage, emergence stage, vegetative stage, and reproductive stages. In one embodiment, the plant is contacted with the preparation of microbes at the stage selected from the post-imbibition, post-germination stage, post-emergence stage, vegetative stage, reproductive stage and post-reproductive stage. In one particular embodiment, the plant is contacted with the microbial preparation at the vegetative and reproductive stages. In still another embodiment, a post-germination, pre-reproductive plant (i.e., before the first flower is open) is contacted with the microbial preparation. In yet another embodiment, a plant at the inflorescence emergence stage and flowering stage are contacted with the microbial preparation.

In an alternative description, the plant is contacted with the microbial preparation at various stages defined by the BBCH scale (see, for example, Zadoks, J. C et al., (1974). Weed Research 14 (6): 415-421, which is incorporated herein in its entirety). While the scale differs by plant species, there are some general growth phases: 0: Germination; 1: Leaf development; 2: Tillering/Development of side shoots; 3: Stem elongation; 4: Booting; 5: Inflorescence emergence, heading; 6: Flowering, anthesis; 7: Development of fruit; 8: Ripening; 9: Senescence; Therefore, in one embodiment, a plant that is between growth phase 0 and growth phase 9 is contacted with the microbial preparation. In another embodiment, a plant that is between growth phase 1 and growth phase 8 is contacted with the microbial preparation. In still another embodiment, a plant that is between growth phase 2 and growth phase 7 is contacted with the microbial preparation. In a particular embodiment, a plant that is between growth phase 5 and growth phase 7 is contacted with the microbial preparation. In still another embodiment, a plant that is between growth phase 1 and growth phase 5 can be contacted with a microbial preparation. In a final embodiment, a plant that is in growth phases 0-5, 7-9 can be contacted with a microbial preparation.

In still another embodiment, a plant is contacted at a time between about 2 weeks prior to flowering and during flowering. In other words, plants at growth stage between 5 and 6 are contacted with the preparation of microbes.

In one embodiment, contacting the flower of a plant with a preparation of microorganisms is performed via spraying the microorganisms at the time of flowering. Spraying is specifically useful as an industrial production method and can be easily automated, e.g., in glasshouse cultures. Other methods include the inoculation by using a brush, or an inoculating loop, or by applying droplets, powders, gels, solids, or other materials containing the microbe.

In some cases, the plant is contacted with the preparation of microbes more than once. For example, the plant can be contacted with the preparation of microbes at least twice, for example, three times, four times, five times, six times, or more. Thus, in one embodiment, the plant that is between growth phase 0 and growth phase 9 is contacted with the microbial preparation more than once. In another embodiment, a plant that is between growth phase 1 and growth phase 8 is contacted more than once with the microbial preparation. In still another embodiment, a plant that is between growth phase 2 and growth phase 7 is contacted more than once with the microbial preparation. In a particular embodiment, a plant that is between growth phase 5 and growth phase 7 is contacted more than once with the microbial preparation. In still another embodiment, a plant that is between growth phase 1 and growth phase 5 can be contacted more than once with a microbial preparation. In a final embodiment, a plant that is in growth phases 0-5, 7-9 can be contacted more than once with a microbial preparation. The interval between contacting can be between about 1 day and 21 days, for example between about 1 day and 2 days, between about 1 day and 3 days, between about 2 days and 4 days, between about 3 days and 6 days, between about 4 days and 7 days, between about 5 days and 10 days, between about 7 days and 14 days, or between about 10 days and 20 days.

There are some suggestions that pathogens may escape the plant's immune system at lower temperatures (see, for example, Szittya et al., (2003) EMBO J. 22: 633-640). Therefore, in some cases, the plants can be incubated at low temperature, for example at temperatures at or below 18° C., for example, at or below 15° C., at or below 12° C., at or below 10° C., at or below 8° C., for any period from the contacting step until maturation of seeds. In one embodiment, the plant is incubated at a low temperature for 1 day after contacting with the preparation of microbes. In another embodiment, the plant is incubated at a low temperature for 2 days after contacting the plant with the preparation of microbes. In still another embodiment, a plant is contacted at least twice with the preparation of microbes, and the plant is subjected to low temperature incubation for two days following each of the contacting steps.

Improved Traits Conferred by the Microbe

The present invention contemplates the establishment of a microbial symbiont in a plant. In one embodiment, the microbial association results in a detectable change to the plant. The detectable change can be an improvement in a number of traits (e.g., improved general health, increased response to biotic or abiotic stresses, or enhanced properties of the plant or a plant part, including fruits and grains). Alternatively, the detectable change can be a physiological or biological change that can be measured by methods known in the art. The detectable changes are described in more detail in the sections below.

In some aspects, provided herein, are methods for producing a seed of a plant with a heritably altered trait. The trait of the plant can be altered without known genetic modification of the plant genome, and comprises the following steps. First, a preparation of an isolated microbe which is heterologous to the seed of the plant is provided, and optionally processed to produce a microbial preparation. The microbial preparation is then contacted with the plant. The plants are then allowed to go to seed, and the seeds, which contain the microbes on and/or in the seed are collected. The microbes contained within the seed are viably incorporated into the seed.

The method of the present invention can facilitate crop productivity by enhancing germination, seedling vigor and biomass in comparison with a non-treated control. Moreover, the introduction of the beneficial microorganisms to within the seed instead of by, e.g., seed coating, makes the microbes less susceptible to environmental perturbation and more compatible with chemical seed coatings (e.g., pesticides and herbicides). Using bacterial colonized seeds, the plant growth and biomass increases are statistically similar to those obtained using conventional inoculation methods e.g., exogenous seed soaking and soil inoculation (that are more laborious and less practicable in certain circumstances).

Improved General Health

Also described herein are plants, and fields of plants, that are associated with beneficial bacterial and/or fungal microbes, such that the overall fitness, productivity or health of the plant or a portion thereof, is maintained, increased and/or improved over a period of time. Improvement in overall plant health can be assessed using numerous physiological parameters including, but not limited to, height, overall biomass, root and/or shoot biomass, seed germination, seedling survival, photosynthetic efficiency, transpiration rate, seed/fruit number or mass, plant grain or fruit yield, leaf chlorophyll content, earlier flowering, photosynthetic rate, root length, or any combination thereof. Improved plant health, or improved field health, can also be demonstrated through improved resistance or response to a given stress, either biotic or abiotic stress, or a combination of one or more abiotic stresses, as provided herein.

Abiotic Stress

Disclosed herein are microbe-associated plants with increased resistance to an abiotic stress. Exemplary abiotic stresses include, but are not limited to:

Drought and Heat Tolerance

In some cases, a plant resulting from seeds containing the microbe can exhibit a physiological change, such as a decreased change in photosynthetic activity (expressed, for example, as $\Delta Fv/Fm$) after exposure to heat shock or drought conditions as compared to a corresponding control, genetically identical plant that does not contain the microbes grown in the same conditions. In some cases, the microbe-associated plant as disclosed herein can exhibit an increased change in photosynthetic activity $\Delta Fv(\Delta Fv/Fm)$ after heat-shock or drought stress treatment, for example 1, 2, 3, 4, 5, 6, 7 days or more after the heat-shock or drought stress treatment, or until photosynthesis ceases, as compared with corresponding control plant of similar developmental stage but not containing the microbes. For example, a plant having a microbe able to confer heat and/or drought-tolerance can exhibit a ΔFv/Fm of from about 0.1 to about 0.8 after exposure to heat-shock or drought stress or a ΔFv/Fm range of from about 0.03 to about 0.8 under one day, or 1, 2, 3, 4, 5, 6, 7, or over 7 days post heat-shock or drought stress treatment, or until photosynthesis ceases. In some embodiments, stress-induced reductions in photosynthetic activity can be reduced by at least about 0.25% (for example, at least about 0.5%, at least about 1%, at least about 2%, at least about 3, at least about 5%, at least about 8%, at least about 10%, at least about 15%, at least about 20%, at least about 25%, at least about 30%, at least about 40%, at least about 50%, at least about 60%, at least about 75%, at least about 80%, at least about 80%, at least about 90%, at least about 95%, at least about 99% or at least 100%) as compared to the photosynthetic activity decrease in a corresponding reference agricultural plant following heat shock conditions. Significance of the difference between the microbe-associated and reference agricultural plants can be established upon demonstrating statistical significance, for example at p<0.05 with an appropriate parametric or non-parametric statistic, e.g., Chi-square test, Student's t-test, Mann-Whitney test, or F-test based on the assumption or known facts that the microbe-associated plant and reference agricultural plant have identical or near identical genomes.

In some embodiments, the plants contain microbes able to confer novel heat and/or drought-tolerance in sufficient quantity, such that increased growth under conditions of heat or drought stress is observed. For example, a heat and/or drought-tolerance microbe population described herein can be present in sufficient quantity in a plant, resulting in increased growth as compared to a plant that does not contain the microbe, when grown under drought conditions or heat shock conditions, or following such conditions. Growth can be assessed with physiological parameters including, but not limited to, height, overall biomass, root and/or shoot biomass, seed germination, seedling survival, photosynthetic efficiency, transpiration rate, seed/fruit number or mass, plant grain or fruit yield, leaf chlorophyll content, earlier flowering, photosynthetic rate, root length, or any combination thereof.

In some cases, a plant resulting from seeds containing a microbe that includes a novel heat and/or drought tolerance microbe population described herein exhibits a difference in the physiological parameter that is at least about 5% greater, for example at least about 5%, at least about 8%, at least about 10%, at least about 15%, at least about 20%, at least about 25%, at least about 30%, at least about 40%, at least about 50%, at least about 60%, at least about 75%, at least about 80%, at least about 80%, at least about 90%, or at least 100%, at least about 200%, at least about 300%, at least about 400% or greater than a reference agricultural plant grown under similar conditions.

In various embodiments, the microbes introduced into altered seed microbiota can confer in the resulting plant thermal tolerance, herbicide tolerance, drought resistance, insect resistance, fungus resistance, virus resistance, bacteria resistance, male sterility, cold tolerance, salt tolerance, increased yield, enhanced nutrient use efficiency, increased nitrogen use efficiency, increased protein content, increased fermentable carbohydrate content, reduced lignin content, increased antioxidant content, enhanced water use efficiency, increased vigor, increased germination efficiency, earlier or increased flowering, increased biomass, altered root-to-shoot biomass ratio, enhanced soil water retention, or a combination thereof. A difference between microbe-associated plant and a reference agricultural plant can also be measured using other methods known in the art (see, for example, Haake et al. (2002) *Plant Physiol.* 130: 639-648)

Salt Stress

In other embodiments, microbes able to confer increased tolerance to salinity stress can be introduced into plants. The resulting plants containing the microbes can exhibit increased resistance to salt stress, whether measured in terms of survival under saline conditions, or overall growth during, or following salt stress. The physiological parameters of plant health recited above, including height, overall biomass, root and/or shoot biomass, seed germination, seedling survival, photosynthetic efficiency, transpiration rate, seed/fruit number or mass, plant grain or fruit yield, leaf chlorophyll content, earlier flowering, photosynthetic rate, root length, or any combination thereof, can be used to measure growth, and compared with the growth rate of reference agricultural plants (e.g., isogenic plants without the microbes) grown under identical conditions. In some cases, a plant resulting from seeds containing a microbe able to confer salt tolerance described herein exhibits a difference in the physiological parameter that is at least about 5% greater, for example at least about 5%, at least about 8%, at least about 10%, at least about 15%, at least about 20%, at least about 25%, at least about 30%, at least about 40%, at least about 50%, at least about 60%, at least about 75%, at least about 80%, at least about 80%, at least about 90%, or at least 100%, at least about 200%, at least about 300%, at least about 400% or greater than a reference agricultural plant grown under the same sodium concentration in the soil.

In other instances, microbe-associated plants and reference agricultural plants can be grown in soil or growth media containing different concentration of sodium to establish the inhibitory concentration of sodium (expressed, for example, as the concentration in which growth of the plant is inhibited by 50% when compared with plants grown under no sodium stress). Therefore, in another embodiment, a plant resulting from seeds containing a microbe able to confer salt tolerance described herein exhibits an increase in the inhibitory sodium concentration by at least 10 mM, for example at least 15 mM, at least 20 mM, at least 30 mM, at least 40 mM, at least 50 mM, at least 60 mM, at least 70 mM, at least 80 mM, at least 90 mM, at least 100 mM or more, when compared with the reference agricultural plants.

III. High Metal Content

Plants are sessile organisms and therefore must contend with the environment in which they are placed. While plants have adapted many mechanisms to deal with chemicals and substances that may be deleterious to their health, heavy metals represent a class of toxins which are highly relevant for plant growth and agriculture. Plants use a number of mechanisms to cope with toxic levels of heavy metals (for example, nickel, cadmium, lead, mercury, arsenic, or aluminum) in the soil, including excretion and internal sequestration. For agricultural purposes, it is important to have plants that are able to tolerate otherwise hostile conditions, for example soils containing elevated levels of toxic heavy metals. Microbes that are able to confer increased heavy metal tolerance may do so by enhancing sequestration of the metal in certain compartments. Use of such microbes in a plant would allow the development of novel plant-microbe combinations for purposes of environmental remediation (also known as phytoremediation). Therefore, in one embodiment, the plant containing the microbe able to confer increased metal tolerance exhibits a difference in a physiological parameter that is at least about 5% greater, for example at least about 5%, at least about 8%, at least about 10%, at least about 15%, at least about 20%, at least about 25%, at least about 30%, at least about 40%, at least about 50%, at least about 60%, at least about 75%, at least about 80%, at least about 80%, at least about 90%, or at least 100%, at least about 200%, at least about 300%, at least about 400% or greater than a reference agricultural plant grown under the same heavy metal concentration in the soil.

Alternatively, the inhibitory concentration of the heavy metal can be determined for the microbe-associated plant and compared with a reference agricultural plant under the same conditions. Therefore, in one embodiment, the plants resulting from seeds containing a microbe able to confer heavy metal tolerance described herein exhibit an increase in the inhibitory sodium concentration by at least 0.1 mM, for example at least 0.3 mM, at least 0.5 mM, at least 1 mM, at least 2 mM, at least 5 mM, at least 10 mM, at least 15 mM, at least 20 mM, at least 30 mM, at least 50 mM or more, when compared with the reference agricultural plants.

Finally, plants inoculated with microbes that are able to confer increased metal tolerance exhibits an increase in overall metal accumulation by at least 10%, for example at least 15%, at least 20%, at least 30%, at least 40%, at least 50%, at least 60%, at least 75%, at least 100%, at least 150%, at least 200%, at least 300% or more, when compared with uninoculated plants grown under the same conditions.

IV. Low Nutrient Stress

The microbes described herein may also confer to the plant an increased ability to grow in nutrient limiting conditions, for example by solubilizing or otherwise making available to the plants macronutrients or micronutrients that are complexed, insoluble, or otherwise in an unavailable form. In one embodiment, a plant is inoculated with a microbe that confers increased ability to liberate and/or otherwise provide to the plant with nutrients selected from the group consisting of phosphate, nitrogen, potassium, iron, manganese, calcium, molybdenum, vitamins, or other micronutrients. Such a plant can exhibit increased growth in soil containing limiting amounts of such nutrients when compared with reference agricultural plant. Differences between the microbe-associated plant and reference agricultural plant can be measured by comparing the biomass of the two plant types grown under limiting conditions, or by measuring the physical parameters described above. Therefore, in one embodiment, the plant containing the microbe able to confer increased tolerance to nutrient limiting conditions exhibits a difference in a physiological parameter that is at least about 5% greater, for example at least about 5%, at least about 8%, at least about 10%, at least about 15%, at least about 20%, at least about 25%, at least about 30%, at least about 40%, at least about 50%, at least about 60%, at least about 75%, at least about 80%, at least about 80%, at least about 90%, or at least about 100%, at least about 200%, at least about 300%, at least about 400% or greater than a reference agricultural plant grown under the same heavy metal concentration in the soil.

V. Cold Stress

In some cases, microbes can confer to the plant the ability to tolerate cold stress. Many known methods exist for the measurement of a plant's tolerance to cold stress (as reviewed, for example, in Thomashow (2001) Plant Physiol. 125: 89-93, and Gilmour et al. (2000) Plant Physiol. 124: 1854-1865, both of which are incorporated herein by reference in their entirety). As used herein, cold stress refers to both the stress induced by chilling (0° C.-15° C.) and freezing (<0° C.). Some cultivars of agricultural plants can be particularly sensitive to cold stress, but cold tolerance traits may be multigenic, making the breeding process difficult. Microbes able to confer cold tolerance would potentially reduce the damage suffered by farmers on an annual basis. Improved response to cold stress can be measured by survival of plants, the amount of necrosis of parts of the plant, or a change in crop yield loss, as well as the physiological parameters used in other examples. Therefore, in one embodiment, the plant containing the microbe able to confer increased cold tolerance exhibits a difference in a physiological parameter that is at least about 5% greater, for example at least about 5%, at least about 8%, at least about 10%, at least about 15%, at least about 20%, at least about 25%, at least about 30%, at least about 40%, at least about 50%, at least about 60%, at least about 75%, at least about 80%, at least about 80%, at least about 90%, or at least about 100%, at least about 200%, at least about 300%, at least about 400% or greater than a reference agricultural plant grown under the same conditions of cold stress.

Biotic Stress

In other embodiments, the bacterial microbe protects the plant from a biotic stress, for example, insect infestation, nematode infestation, bacterial infection, fungal infection, oomycete infection, protozoal infection, viral infection, and herbivore grazing, or a combination thereof.

I. Insect Herbivory

There is an abundance of insect pest species that can infect or infest a wide variety of plants. Pest infestation can lead to significant damage. Insect pests that infest plant species are particularly problematic in agriculture as they can cause serious damage to crops and significantly reduce plant yields. A wide variety of different types of plant are susceptible to pest infestation including commercial crops such as cotton, soybean, wheat, barley, and corn.

In some cases, the microbes described herein may confer upon the host plant the ability to repel insect herbivores. In other cases, the microbes may produce, or induce the production in the plant of, compounds which are insecticidal or insect repellant. The insect may be any one of the common pathogenic insects affecting plants, particularly agricultural plants. Examples include, but are not limited to: *Leptinotarsa* spp. (e.g., *L. decemlineata* (Colorado potato beetle), *L. juncta* (false potato beetle), or *L. texana* (Texan false potato beetle)); *Nilaparvata* spp. (e.g., *N. lugens* (brown planthopper)); *Laode/phax* spp. (e.g., *L. striatellus* (small brown planthopper)); *Nephotettix* spp. (e.g., *N. virescens* or *N. cincticeps* (green leafhopper), or *N. nigropictus* (rice leafhopper)); *Sogatella* spp. (e.g., *S. furcifera* (whitebacked planthopper)); *Chilo* spp. (e.g., *C. suppressalis* (rice striped stem borer), *C. auricilius* (gold-fringed stem borer), or *C. polychrysus* (dark-headed stem borer)); *Sesamia* spp. (e.g., *S. inferens* (pink rice borer)); *Tryporyza* spp. (e.g., *T. innotata* (white rice borer), or *T. incertulas* (yellow rice borer)); *Anthonomus* spp. (e.g., *A. grandis* (boll weevil)); *Phaedon* spp. (e.g., *P. cochleariae* (mustard leaf beetle)); *Epilachna* spp. (e.g., *E. varivetis* (Mexican bean beetle)); *Tribolium* spp. (e.g., *T. castaneum* (red floor beetle)); *Diabrotica* spp. (e.g., *D. virgifera* (western corn rootworm), *D. barberi* (northern corn rootworm), *D. undecimpunctata howardi* (southern corn rootworm), *D. virgifera zeae* (Mexican corn rootworm); *Ostrinia* spp. (e.g., *O. nubilalis* (European corn borer)); *Anaphothrips* spp. (e.g., *A. obscrurus* (grass *thrips*)); *Pectinophora* spp. (e.g., *P. gossypiella* (pink bollworm)); *Heliothis* spp. (e.g., *H. virescens* (tobacco budworm)); *Trialeurodes* spp. (e.g., *T. abutiloneus* (banded-winged whitefly) *T. vaporariorum* (greenhouse whitefly)); *Bemisia* spp. (e.g., *B. argentifolii* (silverleaf whitefly)); *Aphis* spp. (e.g., *A. gossypii* (cotton aphid)); *Lygus* spp. (e.g., *L. lineolaris* (tarnished plant bug) or *L. hesperus* (western tarnished plant bug)); *Euschistus* spp. (e.g., *E. conspersus* (consperse stink bug)); *Chlorochroa* spp. (e.g., *C. sayi* (Say stinkbug)); *Nezara* spp. (e.g., *N. viridula* (southern green stinkbug)); *Thrips* spp. (e.g., *T. tabaci* (onion *thrips*)); *Frankliniella* spp. (e.g., *F. fusca* (tobacco *thrips*), or *F. occidentalis* (western flower *thrips*)); *Acheta* spp. (e.g., *A. domesticus* (house cricket)); *Myzus* spp. (e.g., *M. persicae* (green peach aphid)); *Macrosiphum* spp. (e.g., *M. euphorbiae* (potato aphid)); *Blissus* spp. (e.g., *B. leucopterus* (chinch bug)); *Acrosternum* spp. (e.g., *A. hilare* (green stink bug)); *Chilotraea* spp. (e.g., *C. polychrysa* (rice stalk borer)); *Lissorhoptrus* spp. (e.g., *L. oryzophilus* (rice water weevil)); *Rhopalosiphum* spp. (e.g., *R. maidis* (corn leaf aphid)); and *Anuraphis* spp. (e.g., *A. maidiradicis* (corn root aphid)).

The microbe-associated plant can be tested for its ability to resist, or otherwise repel, pathogenic insects by measuring, for example, overall plant biomass, biomass of the fruit or grain, percentage of intact leaves, or other physiological parameters described herein, and comparing with a reference agricultural plant. In one embodiment, the microbe-associated plant exhibits at least 5% greater biomass, for example, at least 10%, at least 15%, at least 20%, at least 30%, at least 40%, at least 50%, at least 75%, at least 100% or more biomass, than the reference agricultural plant grown under the same conditions (e.g., grown side-by-side, or adjacent to, the microbe-associated plants). In other embodiments, the microbe-associated plant exhibits at least 5% greater fruit or grain yield, for example, at least 10%, at least 15%, at least 20%, at least 30%, at least 40%, at least 50%, at least 75%, at least 100% or more fruit or grain yield, than the reference agricultural plant grown under the same conditions (e.g., grown side-by-side, or adjacent to, the microbe-associated plants).

II. Nematodes

Nematodes are microscopic roundworms that feed on the roots, fluids, leaves and stems of more than 2,000 row crops, vegetables, fruits, and ornamental plants, causing an estimated $100 billion crop loss worldwide and accounting for 13% of global crop losses due to disease. A variety of parasitic nematode species infect crop plants, including root-knot nematodes (RKN), cyst- and lesion-forming nematodes. Root-knot nematodes, which are characterized by causing root gall formation at feeding sites, have a relatively broad host range and are therefore parasitic on a large number of crop species. The cyst- and lesion-forming nematode species have a more limited host range, but still cause considerable losses in susceptible crops.

Signs of nematode damage include stunting and yellowing of leaves, and wilting of the plants during hot periods. Nematode infestation, however, can cause significant yield losses without any obvious above-ground disease symptoms. The primary causes of yield reduction are due to underground root damage. Roots infected by SCN are dwarfed or stunted. Nematode infestation also can decrease the number of nitrogen-fixing nodules on the roots, and may make the roots more susceptible to attacks by other soil-borne plant nematodes.

In one embodiment, the microbe-associated plant has an increased resistance to a nematode when compared with a reference agricultural plant. As before with insect herbivores, biomass of the plant or a portion of the plant, or any of the other physiological parameters mentioned elsewhere, can be compared with the reference agricultural plant grown under the same conditions. Particularly useful measurements include overall plant biomass, biomass and/or size of the fruit or grain, and root biomass. In one embodiment, the microbe-associated plant exhibits at least 5% greater biomass, for example, at least 10%, at least 15%, at least 20%, at least 30%, at least 40%, at least 50%, at least 75%, at least 100% or more biomass, than the reference agricultural plant grown under the same conditions (e.g., grown side-by-side, or adjacent to, the microbe-associated plants, under conditions of nematode challenge). In another embodiment, the microbe-associated plant exhibits at least 5% greater root biomass, for example, at least 10%, at least 15%, at least 20%, at least 30%, at least 40%, at least 50%, at least 75%, at least 100% or more root biomass, than the reference agricultural plant grown under the same conditions (e.g., grown side-by-side, or adjacent to, the microbe-associated plants, under conditions of nematode challenge). In still another embodiment, the microbe-associated plant exhibits at least 5% greater fruit or grain yield, for example, at least 10%, at least 15%, at least 20%, at least 30%, at least 40%, at least 50%, at least 75%, at least 100% or more fruit or grain yield, than the reference agricultural plant grown under the same conditions (e.g., grown side-by-side, or adjacent to, the microbe-associated plants, under conditions of nematode challenge).

III. Fungal Pathogens

Fungal diseases are responsible for yearly losses of over $10 Billion on agricultural crops in the US, represent 42% of global crop losses due to disease, and are caused by a large variety of biologically diverse pathogens. Different strategies have traditionally been used to control them. Resistance traits have been bred into agriculturally important varieties, thus providing various levels of resistance against either a narrow range of pathogen isolates or races, or against a broader range. However, this involves the long and labor intensive process of introducing desirable traits into commercial lines by genetic crosses and, due to the risk of pests evolving to overcome natural plant resistance, a constant effort to breed new resistance traits into commercial lines is required. Alternatively, fungal diseases have been controlled by the application of chemical fungicides. This strategy usually results in efficient control, but is also associated with the possible development of resistant pathogens and can be associated with a negative impact on the environment. Moreover, in certain crops, such as barley and wheat, the control of fungal pathogens by chemical fungicides is difficult or impractical.

The present invention contemplates the use of microbes which are able to confer resistance to fungal pathogens to the host plant. Increased resistance to fungal inoculation can be measured, for example, using any of the physiological parameters presented above, by comparing with reference agricultural plants. In one embodiment, the microbe-associated plant exhibits at least 5% greater biomass, for example, at least 10%, at least 15%, at least 20%, at least 30%, at least 40%, at least 50%, at least 75%, at least 100% or more biomass, than the reference agricultural plant grown under the same conditions (e.g., grown side-by-side, or adjacent to, the microbe-associated plants, infected with the fungal pathogen). In still another embodiment, the microbe-associated plant exhibits at least 5% greater fruit or grain yield, for example, at least 10%, at least 15%, at least 20%, at least 30%, at least 40%, at least 50%, at least 75%, at least 100% or more fruit or grain yield, than the reference agricultural plant grown under the same conditions (e.g., grown side-by-side, or adjacent to, the microbe-associated plants, infected with the fungal pathogen). In another embodiment, the microbe-associated plant exhibits at least a 5% reduction in for hyphal growth, for example, at least 10%, at least 15%, at least 20%, at least 30%, at least 40%, at least 50%, at least 75%, at least 90% reduction or more, in hyphal growth, than the reference agricultural plant grown under the same conditions (e.g., grown side-by-side, or adjacent to, the microbe-associated plants, infected with the fungal pathogen).

Viral Pathogens

Plant viruses are estimated to account for 18% of global crop losses due to disease. There are numerous examples of viral pathogens affecting agricultural productivity. Examples include the American wheat striate mosaic virus (AWSMV) (wheat striate mosaic), Barley stripe mosaic virus (BSMV), Barley yellow dwarf virus (BYDV), Brome mosaic virus (BMV), Cereal chlorotic mottle virus (CCMV), Corn chlorotic vein banding virus (CCVBV), Brazilian maize mosaic virus, Corn lethal necrosis Virus complex from Maize chlorotic mottle virus, (MCMV), Maize dwarf mosaic virus (MDMV), A or B Wheat streak mosaic virus (WSMV), Cucumber mosaic virus (CMV), *Cynodon* chlorotic streak virus (CCSV), Johnsongrass mosaic virus (JGMV), Maize bushy stunt *Mycoplasma*-like organism (MLO) associated virus, Maize chlorotic dwarf Maize chlorotic dwarf virus (MCDV), Maize chlorotic mottle virus (MCMV), Maize dwarf mosaic virus (MDMV), strains A, D, E and F, Maize leaf fleck virus (MLFV), Maize line virus (MLV), Maize mosaic (corn leaf stripe, Maize mosaic virus (MMV), enanismo rayado), Maize mottle and chlorotic stunt virus, Maize pellucid ringspot virus (MPRV), Maize raya gruesa virus (MRGV), Maize rayado fino (fine striping) virus (MRFV), Maize red stripe virus (MRSV), Maize ring mottle virus (MRMV), Maize rio cuarto virus (MRCV), Maize rough dwarf virus (MRDV), Cereal tillering disease virus, Maize sterile stunt virus, barley yellow striate virus, Maize streak virus (MSV), Maize stripe virus, Maize chloroticstripe virus, maize hoja blanca virus, Maize stunting virus; Maize tassel abortion virus (MTAV), Maize vein enation virus (MVEV), Maize wallaby ear virus (MWEV), Maize white leaf virus, Maize white line mosaic virus (MWLMV), Millet red leaf virus (MRLV), Northern cereal mosaic virus (NCMV), Oat pseudorosette virus, (zakuklivanie), Oat sterile dwarf virus (OSDV), Rice black-streaked dwarf virus (RBSDV), Rice stripe virus (RSV), *Sorghum* mosaic virus (SrMV), Sugarcane mosaic virus (SCMV) strains H, 1 and M, Sugarcane Fiji disease virus (FDV), Sugarcane mosaic virus (SCMV) strains A, B, D, E, SC, BC, Sabi and MB (formerly MDMV-B), and Wheat spot mosaic virus (WSMV). In one embodiment, the microbe-associated plant provides protection against viral pathogens such that there is at least 5% greater biomass, for example, at least 10%, at least 15%, at least 20%, at least 30%, at least 40%, at least 50%, at least 75%, at least 100% or more biomass, than the reference agricultural plant grown under the same conditions. In still another embodiment, the microbe-associated plant exhibits at least 5% greater fruit or grain yield, for example, at least 10%, at least 15%, at least 20%, at least 30%, at least 40%, at least 50%, at least 75%, at least 100% or more fruit or grain yield when challenged with a virus, than the reference agricultural plant grown under the same conditions. In yet another embodiment, the microbe-associated plant exhibits at least 5% lower viral titer, for example, at least 10%, at least 15%, at least 20%, at least 30%, at least 40%, at least 50%, at least 75%, at least 100% lower viral titer when challenged with a virus, than the reference agricultural plant grown under the same conditions.

V. Bacterial Pathogens

Likewise, bacterial pathogens are a significant problem negatively affecting agricultural productivity and accounting for 27% of global crop losses due to plant disease. In one embodiment, the microbe-associated plant described herein provides protection against bacterial pathogens such that there is at least 5% greater biomass, for example, at least 10%, at least 15%, at least 20%, at least 30%, at least 40%, at least 50%, at least 75%, at least 100% or more biomass, than the reference agricultural plant grown under the same conditions. In still another embodiment, the microbe-associated plant exhibits at least 5% greater fruit or grain yield, for example, at least 10%, at least 15%, at least 20%, at least 30%, at least 40%, at least 50%, at least 75%, at least 100% or more fruit or grain yield when challenged with a bacterial pathogen, than the reference agricultural plant grown under the same conditions. In yet another embodiment, the microbe-associated plant exhibits at least 5% lower bacterial count, for example, at least 10%, at least 15%, at least 20%, at least 30%, at least 40%, at least 50%, at least 75%, at least 100% lower bacterial count when challenged with a bacteria, than the reference agricultural plant grown under the same conditions.

Improvement of Other Traits

In other embodiments, the inoculated microbe can confer other beneficial traits to the plant. Improved traits can include an improved nutritional content of the plant or plant part used for human consumption. In one embodiment, the microbe-associated plant is able to produce a detectable change in the content of at least one nutrient. Examples of such nutrients include amino acid, protein, oil (including any one of Oleic acid, Linoleic acid, Alpha-linolenic acid, Saturated fatty acids, Palmitic acid, Stearic acid and Trans fats), carbohydrate (including sugars such as sucrose, glucose and fructose, starch, or dietary fiber), Vitamin A, Thiamine (vit. B1), Riboflavin (vit. B2), Niacin (vit. B3), Pantothenic acid (B5), Vitamin B6, Folate (vit. B9), Choline, Vitamin C, Vitamin E, Vitamin K, Calcium, Iron, Magnesium, Manganese, Phosphorus, Potassium, Sodium, Zinc. In one embodiment, the microbe-associated plant or part thereof contains at least 10% more nutrient, for example, at least 20%, at least 30%, at least 40%, at least 50%, at least 60%, at least 70%, at least 80%, at least 90%, at least 100%, at least 150%, at least 200%, at least 300% or more, of the nutrient when compared with reference agricultural plants.

In other cases, the improved trait can include reduced content of a harmful or undesirable substance when compared with reference agricultural plants. Such compounds include those which are harmful when ingested in large quantities or are bitter tasting (for example, oxalic acid, amygdalin, certain alkaloids such as solanine, caffeine, nicotine, quinine and morphine, tannins, cyanide). As such, in one embodiment, the microbe-associated plant or part thereof contains at least 10% less of the undesirable substance, for example, at least 20%, at least 30%, at least 40%, at least 50%, at least 60%, at least 70%, at least 80%, at least 90%, at least 95%, at least 98%, at least 99% less of the undesirable substance when compared with reference agricultural plant. In a related embodiment, the improved trait can include improved taste of the plant or a part of the plant, including the fruit or seed. In a related embodiment, the improved trait can include reduction of undesirable compounds produced by other microbes in plants, such as degradation of *Fusarium* produced deoxynivalenol (also known as vomitoxin and a virulence factor involved in *Fusarium* head blight of maize and wheat) in a part of the plant, including the fruit or seed.

In other cases, the improved trait can be an increase in overall biomass of the plant or a part of the plant, including its fruit or seed.

The microbe-associated plant can also have an altered hormone status or altered levels of hormone production when compared with a reference agricultural plant. An alteration in hormonal status may affect many physiological parameters, including flowering time, water efficiency, apical dominance and/or lateral shoot branching, increase in root hair, and alteration in fruit ripening.

The association between the microbe and the plant can also be detected using other methods known in the art. For example, the biochemical, metabolomics, proteomic, genomic, epigenomic and/or transcriptomic profiles of microbe-associated plants can be compared with reference agricultural plants under the same conditions.

Metabolomic differences between the plants can be detected using methods known in the art. For example, a biological sample (whole tissue, exudate, phloem sap, xylem sap, root exudate, etc.) from the microbe-associated and reference agricultural plants can be analyzed essentially as described in Fiehn et al., (2000) Nature Biotechnol., 18, 1157-1161, or Roessner et al., (2001) Plant Cell, 13, 11-29. Such metabolomic methods can be used to detect differences in levels in hormone, nutrients, secondary metabolites, root exudates, phloem sap content, xylem sap content, heavy metal content, and the like. Such methods are also useful for detecting alterations in microbial content and status; for example, the presence and levels of bacterial/fungal signaling molecules (e.g., autoinducers and pheromones), which can indicate the status of group-based behavior of microbes based on, for example, population density (see, for example Daniels et al., (2006). PNAS 103: 14965-14970. Eberhard et al., (1981). Biochemistry 20 (9): 2444-2449). Transcriptome analysis (reviewed, for example, in Usadel & Fernie, (2013). Front Plant Sci. 4:48) of microbe-associated and reference agricultural plants can also be performed to detect changes in expression of at least one transcript, or a set or network of genes upon microbe association. Similarly, epigenetic changes can be detected using methylated DNA immunoprecipitation followed by high-throughput sequencing (Vining et al., (2013) BMC Plant Biol. 13:92).

Plants Useful for the Invention

The methods described herein are useful for producing a seed containing a microbe that is heterologous to the seed. The seed can be from any plant species that produces a seed (i.e., any spermatophyte). Suitable plants include both monocots and dicots (including eudicots) that can be colonized by the microorganisms according to the present invention. Preferably, the plant is a flowering plant (angiosperm) in order to most efficiently transfer the microorganisms to the seed. The resulting seeds contain the inoculated microbes at a detectable level. Plants grown from such seeds contain the microbes in part or all of their tissues, and the microbe may confer beneficial properties (e.g., enhanced growth, increased stress resilience, etc.) of the microbe can develop in the seeds or plants. Accordingly, the plants arising from such seeds—wherein the microbe can confer its beneficial function to the plant—may be at any stage of growth, including seeds, seedlings, or full plants. The present invention is therefore not limited to the application of microorganisms to a given plant (or seed) in order to provide the beneficial microbial effect only to this plant, but it provides a method which encapsulates and safeguards the presence of microbes in the seeds generated from this plant and therefore provides the microbes to the subsequent generations of the plant. This differs significantly from all other inoculation strategies attempted to date (seed impregnation, spraying the microorganisms to the seeds, germs or the whole plants), in that the present method deals with the production of seeds which contain a reproducible and heritable microbial population.

The plant can be monocotyledonous. The plant can be dicotyledonous. In one embodiment, the plant is an agricultural plant. As used herein, an "agricultural plant" is a plant that is cultivated for agriculture to provide food, animal feed, fiber, or any other useful commodity product. In still another embodiment, the agricultural plant is a cereal plant.

In one embodiment, the target plant is a plant of the family Graminae (grasses). The grass plants into which these endophytes are introduced may be any of the useful grasses belonging to the genera *Agropyron, Agrostis, Andropogon, Anthoxanthum, Arrhenatherum, Avena, Brachypodium, Bromus, Chloris, Cynodon, Dactylis, Elymus, Eragrostis, Festuca, Glyceria, Hierochloe, Hordeum, Lolium, Oryza, Panicum, Paspalum, Phalaris, Phleum, Poa, Setaria, Sorghum, Triticum, Zea* and *Zoysia*.

In another embodiment, the target plant is selected from the wheats, including, *Triticum monococcum, Triticum durum, Triticum turgidum, Triticum timopheevi* (Timopheevs Wheat) and *Triticum aestivum* (Bread Wheat).

In another embodiment, the target plant is a corn of the genus *Zea. Zea* is a genus of the family Graminae (Poaceae), commonly known as the grass family. The genus consists of some four species: *Zea mays*, cultivated corn and teosinte; *Zea diploperennis* Iltis et al., diploperennial teosinte; *Zea luxurians* (Durieu et Asch.) Bird; and *Zea perennis* (Hitchc.) Reeves et Mangelsd., perennial teosinte.

Other useful grasses which may be used on an industrial basis are rye grasses and bluegrasses. Bluegrasses known in the art include Kentucky bluegrass, Canada bluegrass, rough meadow grass, bulbous meadow grass, alpine meadow grass, wavy meadow grass, wood meadow grass, Balforth meadow grass, swamp meadow grass, broad leaf meadow grass, narrow leaf meadow grass, smooth meadow grass, spreading meadow grass and flattened meadow grass.

In another embodiment, the plants for which seeds are produced by the method according to the present invention are dicots, including eudicots such as tomato, watermelon, squash, cucumber, strawberry, pepper, soybean, peanut, Brassicaceae, especially rape, sunflower, sugar beet, cotton, alfalfa and *Arabidopsis*.

Accordingly, in one embodiment, the plant is selected from the group of Graminae (grasses), including grasses of the genera *Agropyron, Agrostis, Andropogon, Anthoxanthum, Arrhenatherum, Avena, Brachypodium, Bromus, Chloris, Cynodon, Dactylis, Elymus, Eragrostis, Festuca, Glyceria, Hierochloe, Hordeum*, including *Hordeum vulgare* L., *Hordeum distichon* L., and *Hordeum irregulare, Lolium, Oryza, Panicum, Paspalum, Phalaris, Phleum, Poa, Setaria, Sorghum, Triticum, Zea*, especially *Zea mays*, cultivated corn and teosinte, *Zea diploperennis* Iltis et al., diploperennial teosinte, *Zea luxurians* (Durieu et Asch.) Bird; and *Zea perennis* (Hitchc.) Reeves et Mangelsd., perennial teosinte, and *Zoysia*; wheats, including *Triticum monococcum, Triticum turgidum, Triticum timopheevi* (Timopheevs Wheat) and *Triticum aestivum* (Bread Wheat); rye grasses and bluegrasses, especially Kentucky bluegrass, Canada bluegrass, rough meadow grass, bulbous meadow grass, alpine meadow grass, wavy meadow grass, wood meadow grass, Balforth meadow grass, swamp meadow grass, broad leaf meadow grass, narrow leaf meadow grass, smooth meadow grass, spreading meadow grass and flattened meadow grass; dicots, including eudicots, for example tomato, watermelon, squash, cucumber, strawberry, pepper, soybean, peanut, Brassicaceae, especially rape, sunflower, sugar beet, cotton, alfalfa and *Arabidopsis*.

Cultivars

The present invention contemplates the use of commercial cultivars of agricultural plants. The microbes described herein can be inoculated with such commercial cultivars using the methods provided herein. Non-limiting examples of commercial cultivars are provided below.

Maize

Exemplary *Zea* cultivars provided herein include 39V07, 38H03AM1, P9675, P9675YXR, P9630AM1, P9990AM1, P9917, P9917AM1, P9910AM1, P9910AMRW, P9910AMX, P9910XR, P0062AMX, P0062XR, P0193AM, P0193HR, P0216HR, P0210HR, 36V51, 36V52, 36V53, 36V59, P0313AM1, P0313XR, P0463AM1, P0461AMX, P0461EXR, P0461XR, P0453AM, P0453HR, P0448, P0448AMRW, P0448AMX, P0448E, P0448EHR, P0448R, P0413AM1, P0413E, P0407AMXT, P0533AM1, P0533EXR, P0528AMX, P0528YXR, 35F40, P0652AMX, P0636AM1, P0636HR, P0621HR, P0621R, P0717HR, P0832AM1, P0832E, P0832EXR, P0832XR, 34F29, P0993AM1, P0993HR, P0993XR, P0987AM1, P0987HR, P0916EHR, 34R6, 7P1023AM-R, P1018EHR, P1018HR, 34F06, 34F07, P1184, P1162AM1, P1162AMRW-R, P1162AMX-R, P1162EXR, P1162XR, P1151AM, P1151AM1, P1151R, P1142AMX, 33W80, 33W82, 33W84, 33W88AM1, P1281HR, P1253E, P1248AM, P1221AMX, P1221AMXT, P1215AM1, P1395, P1395AM1, P1395HR, P1395R, P1376XR, P1365AMX, P1360CHR, P1360HR, P1339AM1, P1324HR, 33Z74, 33T56, 33T57, 33M16, P1498, P1498AM, P1498HR, P1498R, P1480HR, P1477WHR, P1431W, P1431WR, P1420HR, 33G61, 33F12, P1555CHR, 33D42, 33D46, 33D49, P1659W, P1659WHR, 32D78, P1745HR, 32B16, P1995W, and P2088HR from Pioneer Hi-Bred, which are grown in geographical entities including Iowa. Exemplary *Zea* cultivars provided herein include P0115AM1, P0392AMX, P0496AMX, P0432AM1, P0413AM1, P0413AMRW, P0413E, P0413R, P0533AM1, P0636AM1, P0636YXR, 35K01, 35K02, 35K08, 35K09AM1, 35K10AMRW, 34M78, P0858AMX, P0832AMRW, P0832AMX, P0832E, P0832EXR, P0832R, P0993AM1, P0993HR, P0987AM1, P0987YXR, P0945YXR, P0916EHR, 34R65, P1023AM-R, P1023AMX-R, P1018AM, P1018AM1, P1018AMX, P1018E, P1018R, P1184, P1184AM, P1184AM1, P1184AMRW, P1184R, P1162AM1, P1162AMRW-R, P1162AMX-R, P1162EXR, P1151AM, P1151AM1, 34P91, P1292AMX, P1241AMX, P1221AMX, P1221AMXT, P1215AM1, P1395AM1, P1395AMRW, P1376XR, P1360CHR, P1360HR, P1352AMX, P1339AM1, P1319, P1319AM1, P1319HR, 33T55, 33T56, P1498, P1498AM, P1498CHR, P1498HR, P1498R, P1477W, P1477WHR, P1449XR, P1431W, P1431WR, 33F12, 33D42, P1690HR, P1659W, 32B09, 32B10, 32B16, P1995W, P1995WR, and P2088AM from Pioneer Hi-Bred, which are grown in geographical entities including Illinois.

Exemplary *Zea* cultivars provided herein include P8917XR, P9690AM, P9690HR, P0125R, P0231HR, P0365YHR, P0302CHR, P0474AM1, P0461EXR, P0591AM1, P0541AM1, P0541HR, 35F37, 35F38, 35F48AM1, 35F50AM, P0636AM1, P0636HR, P0636YXR, P0621HR, 35K01, P0876AM, P0876CHR, P0876HR, P0987, P0987AM, P0987AM1, P0987HR, P0987R, P0987YXR, P0916EHR, P0902AM1, P1023AM-R, P1023AMX-R, P1018EHR, P1173AM, P1173CHR, P1173HR, P1173R, P1151AM, P1151AM1, P1151HR, P1151R, P1151YXR, P1105YHR, P1292ER, P1266YHR, P1395AM, P1395AM1, P1395R, P1376XR, P1360HR, P1324HR, P1498AM, P1498AM1, P1498HR, P1498R, P1477W, P1477WHR, P1449XR, P1431W, 33G60, 33G61, 33F12, P1508CHR, 32T16, 33D42, 33D46, 33D47, 33D49, 33D53AM-R, 32T82, 32T84, P1690AM, P1690CHR, P1690HR, P1659W, P1659WHR, P1625CHR, P1625HR, P1768AMX, 32N74AM1, 32B09, 32B10, 32B11, 32B16, P1995W, P1995WR, 31G67AM1, 31G71, P2088AM, P2088YHR, and P2088YXR from Pioneer Hi-Bred, which are grown in geographical entities including Nebraska.

Exemplary *Zea* cultivars provided herein include P9690HR, P0115AM1, P0216HR, P0448E, P0432AM1, P0413AM1, P0413E, P0636AM1, P0636HR, P0636YHR, P0621HR, 35K01, 35K02, 35K08, 35K09AM1, 35K10AMRW, 34M78, P0858AMX, P0832AMX, P0832E, P0832R, P0993AM1, P0993HR, P0987, P0987AM, P0987AM1, P0987HR, P0987YXR, P0945YXR, P0916EHR, P1023AM-R, P1023AMX-R, P1018AM, P1018AM1, P1018AMX, P1018E, P1018R, P1184, P1184AM, P1184AM1, P1184R, P1162AM1, P1162AMRW-R, P1162AMX-R, P1151AM, P1151AM1, P1105YHR, 34P91, P1253E, P1221AMX, P1221AMXT, P1395, P1395AMRW, P1395HR, P1395R, P1376XR, P1360AM, P1360HR, P1352AMX, P1339AM1, P1319, P1319AM1, P1319HR, 33T54, 33T55, 33T56, 33T57, 33N58, P1498, P1498AM, P1498CHR, P1498HR, P1498R, P1477W, P1477WHR, P1449XR, P1431W, P1431WR, 33G60, 33F12, P1659W, P1659WHR, P1646YHR, P1636AM, P1636YHR, P1602YHR, 32D78, 32D79, P1745HR, 32B09, 32B10, 32B16, P1995W, P1995WR, 31P41, and P2088AM from Pioneer Hi-Bred, which are grown in geographical entities including Indiana.

Exemplary *Zea* cultivars provided herein include Gentry® SmartStax® RIB Complete®, including DKC48-12RIB Brand, DKC49-29RIB Brand, DKC53-56RIB Brand, DKC62-08RIB Brand, DKC63-33RIB Brand; DEKALB® Genuity® DroughtGard™ Hybrids, including DKC47-27RIB Brand, DKC50-57RIB Brand, DKC51-20RIB Brand, DKC63-55RIB Brand, DKC65-81RIB Brand; 89 Relative Maturity, including DKC31-10RIB Brand, DKC32-92RIB Brand, DKC33-78RIB Brand, DKC38-03RIB Brand, DKC39-07RIB Brand; 90-99 Relative Maturity, including DKC43-10RIB Brand, DKC44-13RIB Brand, DKC46-20RIB Brand, DKC48-12RIB Brand, DKC49-29RIB Brand; 101-103 Relative Maturity, including DKC51-20RIB Brand, DKC52-30RIB Brand, DKC53-56RIB Brand, DKC53-58RIB Brand, DKC53-78RIB Brand; 104-108 Relative Maturity, including DKC54-38RIB Brand, DKC57-75RIB Brand, DKC57-92RIB Brand, DKC58-87RIB Brand, DKC58-89RIB Brand; 110-111 Relative Maturity, including DKC60-63RIB Brand, DKC60-67RIB Brand, DKC61-16RIB Brand, DKC61-88RIB Brand, DKC61-89RIB Brand; 112-113 Relative Maturity, including DKC62-08RIB Brand, DKC62-97RIB Brand, DKC63-07RIB Brand, DKC63-33RIB Brand, DKC63-55RIB Brand; 114-116 Relative Maturity, including DKC64-69RIB Brand, DKC64-87RIB Brand, DKC65-19RIB Brand, DKC65-79RIB Brand, DKC66-40RIB Brand; 117+ Relative Maturity, including DKC67-57RIB Brand, DKC67-58RIB Brand, DKC67-88RIB Brand, DKC68-05 Brand, and DKC69-29 Brand from DEKALB®, which are grown in geographical entities including the United States.

Soybean

Exemplary soybean cultivars provided herein include 900Y71, 90Y42, P05T24R, 90Y80, 91M01, 91Y01, P10T91R, 91M10, 91Y20, 91Y61, 91Y90, P19T01R, 92Y12, 92Y21, 92Y31, 92Y32, P24T19R, 92Y51, 92Y91, 93M11, and 93Y22 from Pioneer Hi-Bred, which are grown in geographical entities including Iowa.

Exemplary soybean cultivars provided herein include 92Y51, 92Y53, P25T51R, P26T76R, 92M72, 92Y75, 92Y80, P28T33R, 93Y05, 93Y15, 93Y20, 93Y21, 93Y25, 93M42, 93Y40, 93Y41, 93Y43, P34T35L, P35T58R, 93Y60, 93Y72, 93B82, 93Y82, 93Y84, 93L71, P39T67R, 94Y01, 94Y21, 94Y23, 94Y50, 94Y70, and 95Y10 from Pioneer Hi-Bred, which are grown in geographical entities including Illinois.

Exemplary soybean cultivars provided herein include 91Y90, 92Y22, P24T19R, 92Y53, 92Y62, 92M72, 92Y70, 92Y73, 92Y83, 93M11, 93Y13, 93Y15, 93M43, 93Y41, 93Y52, P35T58R, 93M61, 93Y70, 93Y72, 93B82, 93Y84, 93Y92, P39T67R, 94Y01, and 94Y02 from Pioneer Hi-Bred, which are grown in geographical entities including Nebraska.

Exemplary soybean cultivars provided herein include 90Y51, 90Y90, 92Y51, 92Y75, 92Y80, P28T33R, 93Y05, 93Y11, 93Y20, 93Y21, 93Y22, 93Y23, P33T89R, 93M42, 93Y40, 93Y41, 93Y43, P34T35L, 93Y51, 93Y53, P35T58R, 93Y60, 93Y72, 93B82, 93Y82, 93Y84, 93L71, 93Y91, 93Y92, P39T67R, 94Y01, 94Y02, 94L21, 94Y21, 94Y22, 94Y23, 94L51, P43T14L, P44T82SR, 94Y50, P46T21R, 94Y70, P47T36R, 94Y80, and P48T53R from Pioneer Hi-Bred, which are grown in geographical entities including Indiana.

Exemplary soybean cultivars provided herein include AG 0231 GENRR2Y, AG 0333 GENRR2Y, AG 0430 GENRR2Y, AG 0532 GENRR2Y, AG 0732 GENRR2Y, AG 0832 GENRR2Y, AG 0833 GENRR2Y, AG 1031 GENRR2Y, AG 1132 GENRR2Y, AG 1230 GENRR2Y, AG 1233 GENRR2Y, and AG 1431 GENRR2Y from Asgrow, which are grown in geographical entities including the United States.

Exemplary soybean cultivars provided herein include 506-H5, S08-G1, S10-G7, S10-P9, S12-L5, S1447, S17-B3, S17-G8, S18-C2, 520-T6, S20-Y2, S22-F8, S22-S1, S23-P8, S24-K2, S25-E5, S27-H6, S28-A2, S28-K1, S28-U7, S29-V2, S30-E9, S34-N3, S34-Z1, S35-C3, S36-M8, S17-B3, S18-C2, S20-T6, S20-Y2, S22-F8, S22-S1, S24-K2, S25-E5, S27-H6, S28-A2, S28-U7, S29-V2, S30-E9, S31-L7, S34-N3, S34-Z1, S35-C3, S36-M8, S37-B1, S38-S4, S38-W4, S39-U2, S41-J6, S42-W9, S43-K1, and S44-K7 from Syngenta, which are grown in geographical entities including the United States.

Wheat

Exemplary *Triticum* cultivars provided herein include Everest, TAM 111, Armour, TAM 112, Fuller, Duster, T158, Postrock, Endurance, Jagger, Winter Hawk, Art, Overley, Jagalene, Jackpot, Hatcher, Santa Fe, Danby, Billings, T81, TAM 110, AP503 CL2, Aspen, 2137, TAM 113, Hitch, TAM 101, CJ, Centerfield, SY Gold, and Above, which are grown in geographical entities including Kansas.

Exemplary *Triticum* cultivars provided herein include Barlow, Glenn, SY Scren, Faller, Prosper, Kelby, Brennan, RB07, Vantage, WB Mayville, Freyr, Jenna, Mott, Select, Steele-ND, Briggs, Howard, Reeder, Alsen, Rollag, Divide, Alkabo, Mountrail, Tioga, Lebsock, Grenora, Dilse, Ben, DG Max, Pierce, Monroe, DG Star, Jerry, Decade, Hawken, Wesley, Overland, CDC Falcon, SY Wolf, Harding, Darrell, WB Matlock, Millennium, and Boomer, which are grown in geographical entities including N. Dakota.

Exemplary *Triticum* cultivars provided herein include Yellowstone, Genou, CDC Falcon, Rampart, Ledger, Jerry, AP503 CL2, Hawken, Norris, Pryor, Jagalene, Carter, Morgan, Decade, WB Quake, Tiber, Willow Creek, Radiant, Neeley, Vanguard, Promontory, Overland, and Redwin, which are grown in geographical entities including Montana.

Exemplary *Triticum* cultivars provided herein include Duster, Endurance, Jagger, Fuller, OK Bullet, Jackpot, Everest, Billings, TAM 112, TAM 111, Big Max, Overley, Doans, Armour, Santa Fe, Garrison, Deliver, TAM 110, CJ, 2157, Custer, 2137, Scout, Centerfield, Triumph varieties, Dumas, TAM 401, Gallagher, Cutter, T-158, Ike, WB Hitch, Greer, AP 503 CL2, Ruby Lee, Pioneer 2548, Pioneer 2571, and Coker 762, which are grown in geographical entities including Oklahoma.

Exemplary *Triticum* cultivars provided herein include UI Stone, Diva, Petit, Jubilee, Louise, Alturas, Whit, Babe, Cataldo, Alpowa, BrundageCF, Brundage96, Bitterroot, Kaseberg, Amber, Bruneau, AP Legacy, Salute, Ladd, Junction, ORCF101, Mary, Masami, SY Ovation, Skiles, Rod, WB523, Legion, Eltan, WB528, Stephens, Otto, ORCF103, Rosalyn, Madsen, AP Badger, LCS Artdeco, ORCF102, Lambert, Goetze, WB456, WB1020M, AP700CL, Xerpha, Tubbs06, WB1066CL, Eddy, Finley, Juniper, Whetstone, Sprinter1, Paladin, DW, Buchanan, Farnum, Northwest 553, Peregrine, Rimrock, Declo, Esperia, Boundary, Bauermeister, Residence, Symphony, and Estica, which are grown in geographical entities including Washington state.

Exemplary *Triticum* cultivars provided herein include Wesley, Overland, Expedition, Clearfield, Smoky Hill, Arapahoe, Lyman, Hawken, Millennium, Jagalene, CDC Falcon, Alliance, Nekota, Briggs, RB07, Brick, Faller, Howard, Select, Traverse, Steele ND, Forge, Barlow, Butte86/Butte, Granger, Brennan, which are grown in geographical entities including South Dakota.

Barley

Exemplary barley cultivars provided herein include Azure, Beacon, Bere, Betzes, Bowman, Celebration, Centennial, Compana, Conlon, Diamant, Dickson, Drummond, Excel, Foster, Glenn, Golden Promise, Hazen, Highland barley, Kindred, Kindred L, Larker, Logan, Lux, Manchurian, Manscheuri, Mansury, *Maris* Otter, Morex, Nordal, Nordic, Optic, Park, Plumage Archer, Pearl, Pinnacle, Proctor, Pioneer, Rawson, Robust, Sioux, Stark, Tradition, Traill, Tregal, Trophy, Windich, and Yagan, which are grown throughout the world.

Exemplary barley cultivars provided herein include Tradition, Lacey, Robust, Celebration, Conlon, Pinnacle, Haybet, Legacy, Stellar-D, Innovation, Hays, Quest, Bowman, and Logan, which are grown in geographical entities including North Dakota.

Exemplary barley cultivars provided herein include AC METCALFE, HARRINGTON, CONRAD (B5057), LEGACY (B2978), MORAVIAN 69 (C69), MERIT (B4947), TRADITION (B2482), MORAVIAN 83 (C83), and CHARLES, which are grown in geographical entities including Idaho.

Exemplary barley cultivars provided herein include Harrington, Haybet, B 1202, Moravian, Baronesse, Hector, Bowman, Westford, B Merit, Gallatin, Horsford, Lewis, Stark, Piroline, Valier, B 2601, Legacy, Menuet, Robust, Chinook, and Clark, which are grown in geographical entities including Montana.

Exemplary barley cultivars provided herein include Champion, Bob, Baronesse, Radiant, Haybet, Belford, Camelot, BG, Camas, Gallatin, Copeland, AC Metcalfe, and Harrington, which are grown in geographical entities including Washington state.

Exemplary barley cultivars provided herein include Moravian 69, C-115, C-128, Scarlett, Baronesse, Hays, and Steptoe, which are grown in geographical entities including Colorado.

Cotton

Exemplary *Gossypium* cultivars provided herein include Deltapine DP 1044 B2RF, DP 1252 B2RF, DP 1050 B2RF, and DP 1219 B2RF; Fibermax FM 2484 B2F, FM 9063 B2F, FM 1944 GLB2, and FM 1740 B2F; Phytogen PHY 499 WRF, PHY 375 WRF, and PHY 367 WRF; Americot NG 4111RF, NG 1511 B2RF, and NG 3348 B2RF; Stoneville varieties; Dyna-Gro varieties; and All-Tex varieties, which are varieties of upland cotton (*Gossypium hirsutum*).

Exemplary *Gossypium* cultivars provided herein include Phytogen PHY 805 RF, Phytogen PHY 802 RF, and Deltapine DP 340, which are varieties of pima cotton (*Gossypium barbadense*).

Exemplary *Gossypium* cultivars provided herein include Bayer CropScience FM 958; AFD 2485; Deltapine 340; All-Tex A102, All-Tex 7A21, All-Tex LA122; Americot UA48; Bayer CropScience FM 989; Downer Cotton Genetics DCG 1374; Seed Source Genetics CT 210; and Stoneville LA 887, which are varieties of cotton planted by organic farmers.

Genetically Modified Plants

The methods described herein can also be used with genetically modified plants, for example, to yield additional trait benefits to a plant. For example, a genetically modified plant which is, by means of the transgene, optimized with respect to a certain trait, can be further augmented with additional trait benefits conferred by the newly introduced microbe. Therefore, in one embodiment, a genetically modified plant is contacted with a microbe. The genetically modified plant can be any one of the plants described in Table 8.

Introducing Microbes into New Cultivars

In another aspect, provided are new methods for the assembly of new plant cultivars with a defined microbial background. Thus, in one embodiment, to assemble a new plant cultivar with a defined composition of microbes, the desired microbes population is introduced into the female lineage of plants. Then the male genome is introduced into the female lines by routine pollination to create an F1 hybrid. This pollination results in a new genetic complement in the genetic background of the microbes. Such hybrids can be commercialized using methods known in the art. Where it is desired that the paternal genome is present in the microbial background then this can be done by contacting the male lineage plants with the microbes as described herein. Alternatively, the F1 hybrid generated as described above can be repeatedly backcrossed with the paternal line until much of the female plant genome has been replaced with the paternal genome by repeated meiotic recombinations. By these methods a trait being conferred by the presence of microbes can be transferred to any genetic background, inbred or hybrid.

Seed Coating Compositions

The seeds generated using the methods described herein can be further treated. Many commercial seeds are treated on the surface to contain a seed coating composition order to reduce yield losses during cultivation and to enhance the agronomic and nutritional value of the produce. As such, in one embodiment, the seeds are coated with a seed coating composition; the agent can be selected from the group consisting of a control agent, a plant growth regulator, and a fertilizer/nutrient. As used herein, agents used for eliminating or reducing the damage caused by a pathogen or pest on the plant or seed are referred to as a "control agent". A control agent includes such agents that can be used to kill or repel a pest or pathogen, including a fungus, bacterium, insect, nematode, or bird. In one embodiment, the seed is treated with a control agent, which is selected from the group consisting of fungicides, insecticides, rodenticides, nematicides, miticides or bird repellents, a plant growth regulator and a fertilizer/nutrient.

Fungicide

In one embodiment, the control agent is a fungicide. As used herein, a fungicide is any compound or agent (whether chemical or biological) that can either inhibit the growth of a fungus or kill a fungus. In that sense, a "fungicide", as used herein, encompasses compounds that may be fungistatic or fungicidal. As used herein, the fungicide can be a protectant, or agents that are effective predominantly on the seed surface, providing protection against seed surface-borne pathogens and providing some level of control of soil-borne pathogens. Non-limiting examples of protectant fungicides include captan, maneb, thiram, or fludioxonil.

The fungicide can be a systemic fungicide, which can be absorbed into the emerging seedling and inhibit or kill the fungus inside host plant tissues. Systemic fungicides used for seed treatment include, but are not limited to the following: azoxystrobin, carboxin, mefenoxam, metalaxyl, thiabendazole, trifloxystrobin, and various triazole fungicides, including difenoconazole, ipconazole, tebuconazole, and triticonazole. Mefenoxam and metalaxyl are primarily used to target the water mold fungi *Pythium* and *Phytophthora*. Some fungicides are preferred over others, depending on the plant species, either because of subtle differences in sensitivity of the pathogenic fungal species, or because of the differences in the fungicide distribution or sensitivity of the plants.

A fungicide can be a biological control agent, such as a bacterium or fungus. Such organisms may be parasitic to the pathogenic fungi, or secrete toxins or other substances which can kill or otherwise prevent the growth of fungi.

Any type of fungicide, particularly ones that are commonly used on plants, can be used as a control agent in a seed composition. Non-limiting examples of chemical fungicides that can be used are shown in Table 9. In another embodiment, the fungicide is selected from the group listed on Table 10.

Antibacterial Compositions

In some cases, the seed coating composition comprises a control agent which has antibacterial properties. In one embodiment, the control agent with antibacterial properties is selected from the compounds listed in Table 7. In another embodiment, the compound is Streptomycin, oxytetracycline, oxolinic acid, or gentamicin.

Herbicide

In some cases, an herbicide can be included in the seed coating composition. Non-limiting examples of herbicides which can be used as a control agent of the seed coating application are listed in TABLE 11.

Plant Growth Regulators

In still other embodiments, the seed coat composition comprises a plant growth regulator. The plant growth regulator can be selected from the group provided in TABLE 12. In another embodiment, the plant growth regulator is selected from the group consisting of: Abscisic acid, amidochlor, ancymidol, 6-benzylaminopurine, brassinolide, butralin, chlormequat (chlormequat chloride), choline chloride, cyclanilide, daminozide, dikegulac, dimethipin, 2,6-dimethylpuridine, ethephon, flumetralin, flurprimidol, fluthiacet, forchlorfenuron, gibberellic acid, inabenfide, indole- 3-acetic acid, maleic hydrazide, mefluidide, mepiquat (mepiquat chloride), naphthaleneacetic acid, N-6-benzyladenine, paclobutrazol, prohexadione (prohexadione-calcium), prohydrojasmon, thidiazuron, triapenthenol, tributyl phosphorotrithioate, 2,3,5-tri-iodobenzoic acid, trinexapac-ethyl and uniconazole. Other examples of antibacterial compounds which can be used as part of a seed coating composition include those based on dichlorophene and benzylalcohol hemi formal (Proxel® from ICI or Acticide® RS from Thor Chemie and Kathon® MK from Rohm & Haas) and isothiazolinone derivatives such as alkylisothiazolinones and benzisothiazolinones (Acticide® MBS from Thor Chemie). Other plant growth regulators that can be incorporated seed coating compositions are described in US 2012/0108431, which is incorporated by reference in its entirety.

Insecticide

In some cases, the seed coating composition can comprise an insecticide as a control agent. Any insecticide commonly used in agriculture can be used as a control agent. In one embodiment, the insecticide is selected from the group listed in TABLE 13.

Nematicide

Preferred nematode-antagonistic biocontrol agents include ARF18; *Arthrobotrys* spp.; *Chaetomium* spp.; *Cylindrocarpon* spp.; *Exophilia* spp.; *Fusarium* spp.; *Gliocladium* spp.; *Hirsutella* spp.; *Lecanicillium* spp.; *Monacrosporium* spp.; *Myrothecium* spp.; *Neocosmospora* spp.; *Paecilomyces* spp.; *Pochonia* spp.; *Stagonospora* spp.; vesicular-arbuscular mycorrhizal fungi, *Burkholderia* spp.; *Pasteuria* spp., *Brevibacillus* spp.; *Pseudomonas* spp.; and *Rhizobacteria*.

Particularly preferred nematode-antagonistic biocontrol agents include ARF18, *Arthrobotrys oligospora, Arthrobotrys dactyloides, Chaetomium globosum, Cylindrocarpon heteronema, Exophilia jeanselmei, Exophilia pisciphila, Fusarium aspergilus, Fusarium solani, Gliocladium catenulatum, Gliocladium roseum, Gliocladium virens, Hirsutella rhossiliensis, Hirsutella minnesotensis, Lecanicillium lecanii, Monacrosporium drechsleri, Monacrosporium gephyropagum, Myrotehcium verrucaria, Neocosmospora vasinfecta, Paecilomyces lilacinus, Pochonia chlamydosporia, Stagonospora heteroderae, Stagonospora phaseoli*, vesicular-arbuscular mycorrhizal fungi, *Burkholderia cepacia, Pasteuria penetrans, Pasteuria thornei, Pasteuria nishizawae, Pasteuria ramosa, Pastrueia usage, Brevibacillus laterosporus* strain G4, *Pseudomonas fluorescens* and *Rhizobacteria*.

Nutrients/Fertilizers

In another embodiment, the seed coating composition can comprise a nutrient. The nutrient can be selected from the group consisting of a nitrogen fertilizer including, but not limited to Urea, Ammonium nitrate, Ammonium sulfate, Non-pressure nitrogen solutions, Aqua ammonia, Anhydrous ammonia, Ammonium thiosulfate, Sulfur-coated urea, Urea-formaldehydes, IBDU, Polymer-coated urea, Calcium nitrate, Ureaform, and Methylene urea, phosphorous fertilizers such as Diammonium phosphate, Monoammonium phosphate, Ammonium polyphosphate, Concentrated superphosphate and Triple superphosphate, and potassium fertilizers such as Potassium chloride, Potassium sulfate, Potassium-magnesium sulfate, Potassium nitrate. Such compositions can exist as free salts or ions within the seed coat composition. Alternatively, nutrients/fertilizers can be complexed or chelated to provide sustained release over time.

Rodenticide

Rodents such as mice and rats cause considerable economical damage by eating and soiling planted or stored seeds. Moreover, mice and rats transmit a large number of infectious diseases such as plague, typhoid, leptospirosis, trichinosis and salmonellosis.

Anticoagulants such as coumarin and indandione derivatives play an important role in the control of rodents. These active ingredients are simple to handle, relatively harmless to humans and have the advantage that, as the result of the delayed onset of the activity, the animals being controlled identify no connection with the bait that they have ingested, therefore do not avoid it. This is an important aspect in particular in social animals such as rats, where individuals act as tasters.

In one embodiment, the seed coating composition comprises a rodenticide selected from the group of substances consisting of 2-isovalerylindan-1,3-dione, 4-(quinoxalin-2-ylamino)benzenesulfonamide, alpha-chlorohydrin, aluminum phosphide, antu, arsenous oxide, barium carbonate, bisthiosemi, brodifacoum, bromadiolone, bromethalin, calcium cyanide, chloralose, chlorophacinone, cholecalciferol, coumachlor, coumafuryl, coumatetralyl, crimidine, difenacoum, difethialone, diphacinone, ergocalciferol, flocoumafen, fluoroacetamide, flupropadine, flupropadine hydrochloride, hydrogen cyanide, iodomethane, lindane, magnesium phosphide, methyl bromide, norbormide, phosacetim, phosphine, phosphorus, pindone, potassium arsenite, pyrinuron, scilliroside, sodium arsenite, sodium cyanide, sodium fluoroacetate, strychnine, thallium sulfate, warfarin and zinc phosphide.

It is, of course, also possible to provide a coating with additional microorganisms (either the same or different as the microbe that was inoculated). Therefore, according to another embodiment of the present invention, the obtained plant seed containing microorganisms is therefore subjected to a further seed impregnation step.

Preparation of Commercial Seeds

In another aspect, methods for the production of a uniform population of the seeds at a commercial scale are provided. The method comprises planting a plurality of parental seeds containing the microbe using the methods described herein, germinating the seeds and growing the resulting plants to maturity, and collecting commercial seeds from the plants. In one embodiment, the microbe population in at least 70%, for example, at least 75%, at least 80%, at least 90%, at least 95% or more of the commercial seeds is substantially the same. In some cases, the seeds are considered substantially the same when at least 70% of the seeds, for example, at least 75%, at least 80%, at least 90%, at least 95% or more of the seeds contains the microbe. In another embodiment, the commercial seeds are considered substantially the same when at least at least 70% of the seeds, for example, at least 75%, at least 80%, at least 90%, at least 95% or more of the seeds contains at least 10 CFU, for example, at least 100 CFU, at least 300 CFU, at least 1,000 CFU, at least 3,000 CFU or more, of the microbe.

Optionally, the method can also include an additional step of contacting the resulting plants with a synthetic preparation of the microbes. The above cycle of planting seeds containing the desired microbe can be performed multiple times in succession in order to produce enough seeds for commercial agriculture. In these circumstances, samples of seeds can be checked at each generation to ensure uniformity of seeds as described above. Additional steps can be taken to enhance the probability that the seeds contain the desired microbes. In one embodiment, plants can be further contacted with microbes at each generation using the methods described herein. In another embodiment, the soil on which plants are grown can be enriched with the desired microbes. In still another embodiment, the seeds are coated with the desired microbes before replanting to produce the next generation of seeds. Where the final commercial product is an F1 hybrid, such as is the case with maize, the two parental inbred strains are grown in the field in adjacent rows and the female line has its tassels removed before pollination time and so its stigmas are necessarily pollinated by pollen from the male-designated line. The hybrid seeds are then harvested from the female line and so carry the microbes possessed by the female line, assuming that no microbes are transmitted via the pollen from the male parent. In this way the plant genes from the male line are brought into the genetic complement of the microbes of the female line.

The methods for the production of a uniform population of the seeds at a commercial scale can further comprise additional steps. For example, collected seeds can be further treated by any of the steps selected from hulling, cleaning, sorting, grading, and certifying. In one embodiment the commercial seeds are further processed to eliminate other crop seeds to less than 5% of total seeds, for example, no more than 4%, no more than 3%, no more than 2%, no more than 1%, no more than 0.5%, no more than 0.3%, or less of total seeds. In other cases, the commercial seed preparation is cleaned so that the preparation contains no more than 5% of inert matter, for example, no more than 4%, no more than 3%, no more than 2%, no more than 1%, no more than 0.5%, no more than 0.3%, or less of inert matter. In still another embodiment, the commercial seeds are tested to ensure that the seeds have a germination rate of at least 70%, for example, at least 75%, at least 80%, at least 85%, at least 90%, at least 95%, at least 97%, at least 98%, at least 99% or more.

The commercial seeds can be further treated. In one embodiment, the commercial seeds can be coated with a seed coating composition as described elsewhere.

Commodity Plant Product

The present invention provides a commodity plant product that is derived from a plant of the present invention. As used herein, a "commodity plant product" refers to any composition or product that is comprised of material derived from a plant, seed, plant cell, or plant part of the present invention. Commodity plant products may be sold to consumers and can be viable or nonviable. Nonviable commodity products include but are not limited to nonviable seeds and grains; processed seeds, seed parts, and plant parts; dehydrated plant tissue, frozen plant tissue, and processed plant tissue; seeds and plant parts processed for animal feed for terrestrial and/or aquatic animal consumption, oil, meal, flour, flakes, bran, fiber, and any other food for human or animal consumption; and biomasses and fuel products. Any such commodity plant product that is derived from the plants of the present invention may contain at least a detectable amount of the specific and unique DNA corresponding to the microbes described herein. Any standard method of detection for polynucleotide molecules may be used, including methods of detection disclosed herein.

Pre-Treating Plants to Reduce Carriage of Endogenous Microbes

In some cases, it may be beneficial or preferable to use plants that are modulated to reduce their carriage of endogenous microbes. As used herein, a plant that is depleted, sterilized, or reduced in its carriage of an endogenous microbe is one in which some, substantially all, or all of the endogenous microbiota that reside within the plant are removed. Microbes within a plant are typically resistant to surface sterilization by chemical agents such as detergents, bleach (sodium hypochlorite), hydrogen peroxide, or ethanol, which do not penetrate the surface of the plant in sufficient amounts. Surface sterilization of seeds, for example, is a convenient means to distinguish between surface-residing microbes (which are sensitive to surface sterilization), and endogenous microbes (which are resistant to such methods of surface sterilization). In order to remove (i.e., kill) some, substantially all, or all of the endogenous microbes, additional treatments are required. For example, in one embodiment, a plant or a part thereof (including a seed) can be treated with an antibacterial agent that has sufficient permeability to enter the plant tissues and kill or hinder endogenous bacteria. One of ordinary skill in the art will appreciate that such agents should ideally be agents that do not compromise the viability of the plant, at least at the concentration used. The agent should also have a broad spectrum to target as many bacteria as possible. In the alternative, a combination of antibacterial agents can be used. A non-limiting list of antibiotics is found in TABLE 7.

In one embodiment, the plant or part thereof is contacted with an antibacterial agent selected from the group consisting of: Amikacin, Gentamicin, Kanamycin, Neomycin, Netilmicin, Tobramycin, Paromomycin, Spectinomycin, Ansamycins, Geldanamycin, Herbimycin, Rifaximin, streptomycin, Carbacephem, Loracarbef, Carbapenems, Ertapenem, Doripenem, Imipenem/Cilastatin, Meropenem, Cefadroxil, Cefazolin, Cefalotin or Cefalothin, Cefalexin, Cefaclor, Cefamandole, Cefoxitin, Cefprozil, Cefuroxime, Cefixime, Cefdinir, Cefditoren, Cefoperazone, Cefotaxime, Cefpodoxime, Ceftazidime, Ceftibuten, Ceftizoxime, Ceftriaxone, Cefepime, Ceftaroline fosamil, Ceftobiprole, Glycopeptides, Teicoplanin, Vancomycin, Telavancin, Lincosamides, Clindamycin, Lincomycin, Lipopeptide, Daptomycin, Azithromycin, Clarithromycin, Dirithromycin, Erythromycin, Roxithromycin, Troleandomycin, Telithromycin, Spiramycin, Monobactams, Aztreonam, Nitrofurans, Furazolidone, Nitrofurantoin, Linezolid, Posizolid, Radezolid, Torezolid, Amoxicillin, Ampicillin, Azlocillin, Carbenicillin, Cloxacillin, Dicloxacillin, Flucloxacillin, Mezlocillin, Methicillin, Nafcillin, Oxacillin, Penicillin G, Penicillin V, Piperacillin, Penicillin G, Temocillin, Ticarcillin, Penicillin combinations, Amoxicillin/clavulanate, Ampicillin/sulbactam, Piperacillin/tazobactam, Ticarcillin/clavulanate, Polypeptides, Bacitracin, Colistin, Polymyxin B, Ciprofloxacin, Enoxacin, Gatifloxacin, Levofloxacin, Lomefloxacin, Moxifloxacin, Nalidixic acid, Norfloxacin, Ofloxacin, Trovafloxacin, Grepafloxacin, Sparfloxacin, Temafloxacin, Mafenide, Sulfacetamide, Sulfadiazine, Silver sulfadiazine, Sulfadimethoxine, Sulfamethizole, Sulfamethoxazole, Sulfanilimide (archaic), Sulfasalazine, Sulfisoxazole, Trimethoprim-Sulfamethoxazole (Co-trimoxazole) (TMP-SMX), Sulfonamidochrysoidine (archaic), Demeclocycline, Doxycycline, Minocycline, Oxytetracycline, Tetracycline Clofazimine, Dapsone, Capreomycin, Cycloserine, Ethambutol, Ethionamide, Isoniazid, Pyrazinamide, Rifampicin (Rifampin in US), Rifabutin, Rifapentine, Streptomycin, Arsphenamine, Chloramphenicol, Fosfomycin, Fusidic acid, Metronidazole, Mupirocin, Platensimycin, Quinupristin/Dalfopristin, Thiamphenicol, Tigecycline, Tinidazole, and Trimethoprim.

In another embodiment, a plant or a part thereof (including a seed) is treated with an antifungal agent. In one embodiment the plant or part thereof is cured of some, substantially all, or all of the endogenous fungal microbes by contacting with an antifungal agent. In one embodiment, the antifungal agent is selected from the group consisting of:

Polyene antifungals (Amphotericin B, Candicidin, Filipin, Hamycin, Natamycin, Nystatin, Rimocidin); Imidazole, triazole, and thiazole antifungals (Canesten (clotrimazole), Bifonazole, Butoconazole, Clotrimazole, Econazole, Fenticonazole, Isoconazole, Ketoconazole, Miconazole, Omoconazole, Oxiconazole, Sertaconazole, Sulconazole, Tioconazole, Albaconazole, Fluconazole, Isavuconazole, Itraconazole, Posaconazole, Ravuconazole, Terconazole, Voriconazole, Abafungin), Allylamines (Amorolfin, Butenafine, Naftifine, Terbinafine), Echinocandins (Anidulafungin, Caspofungin, Micafungin), Benzoic acid, Ciclopirox, Flucytosine or 5-fluorocytosine, Griseofulvin, Haloprogin, Polygodial, Tolnaftate, Undecylenic acid and Crystal violet.

It will be appreciated by one of skill in the art that some plants may contain both bacterial and fungal endogenous microbes. As such, in one embodiment, a plant or part thereof is contacted with a combination of an antibacterial agent and an antifungal agent.

As described herein, the antimicrobial agents (whether antibacterial or antifungal) are contacted with the plant or part thereof at a dosage, and for a time, sufficient to kill the endogenous microbes. The elimination of endogenous microbes can be monitored by removing a portion of the plant at various times, homogenizing the tissue, and plating the homogenate on media that support bacterial and/or fungal growth. Alternatively, after contacting the plant or part thereof with the antimicrobial agent, the plant can be allowed to grow in a sterile environment for a certain time before removing a portion of the plant. The tissue is then tested for the presence of microbial DNA by, for example, PCR using primers specific for bacteria or fungi.

Utilizing Microbes Compatible with Agrichemicals

In certain embodiments, the microbe is selected on the basis of its compatibility with commonly used agrichemicals. As mentioned earlier, plants, particularly agricultural plants, can be treated with a vast array of agrichemicals, including fungicides, biocides (anti-bacterial agents), herbicides, insecticides, nematicides, rodenticides, fertilizers, and other agents.

In some cases, it can be important for the microbe to be compatible with agrichemicals, particularly those with fungicidal or antibacterial properties, in order to persist in the plant although, as mentioned earlier, there are many such fungicidal or antibacterial agents that do not penetrate the plant, at least at a concentration sufficient to interfere with the microbe. Therefore, where a systemic fungicide or antibacterial agent is used in the plant, compatibility of the microbe to be inoculated with such agents will be an important criterion.

In one embodiment, natural isolates of microbes which are compatible with agrichemicals can be used to inoculate the plants according to the methods described herein. For example, fungal microbes which are compatible with agriculturally employed fungicides can be isolated by plating a culture of the microbes on a petri dish containing an effective concentration of the fungicide, and isolating colonies of the microbe that are compatible with the fungicide. In another embodiment, a microbe that is compatible with a fungicide is used for the methods described herein. For example, the microbe is compatible with at least one of the fungicides listed on Table 10. In another embodiment, the microbe is compatible with at least one of the fungicides listed on Table 11. In still another embodiment, a microbe that is compatible with an antibacterial compound is used for the methods described herein. For example, the microbe is compatible with at least one of the antibiotics listed on Table 7. Fungicide compatible microbes can also be isolated by selection on liquid medium. The culture of microbes can be plated on petri dishes without any forms of mutagenesis; alternatively, the microbes can be mutagenized using any means known in the art. For example, microbial cultures can be exposed to UV light, gamma-irradiation, or chemical mutagens such as ethylmethanesulfonate (EMS) prior to selection on fungicide containing media. Finally, where the mechanism of action of a particular fungicide is known, the target gene can be specifically mutated (either by gene deletion, gene replacement, site-directed mutagenesis, etc.) to generate a microbe that is resilient against that particular fungicide. It is noted that the above-described methods can be used to isolate fungi that are compatible with both fungistatic and fungicidal compounds.

It will also be appreciated by one skilled in the art that a plant may be exposed to multiple types of fungicides or antibacterial compounds, either simultaneously or in succession, for example at different stages of plant growth. Where the target plant is likely to be exposed to multiple fungicidal and/or antibacterial agents, a microbe that is compatible with many or all of these agrichemicals can be used to inoculate the plant. A microbe that is compatible with several fungicidal agents can be isolated, for example, by serial selection. A microbe that is compatible with the first fungicidal agent is isolated as described above (with or without prior mutagenesis). A culture of the resulting microbe can then be selected for the ability to grow on liquid or solid media containing the second antifungal compound (again, with or without prior mutagenesis). Colonies isolated from the second selection are then tested to confirm its compatibility to both antifungal compounds.

Likewise, bacterial microbes that are compatible to biocides (including herbicides such as glyphosate or antibacterial compounds, whether bacteriostatic or bactericidal) that are agriculturally employed can be isolated using methods similar to those described for isolating fungicide compatible microbes. In one embodiment, mutagenesis of the microbial population can be performed prior to selection with an antibacterial agent. In another embodiment, selection is performed on the microbial population without prior mutagenesis. In still another embodiment, serial selection is performed on a microbe: the microbe is first selected for compatibility to a first antibacterial agent. The isolated compatible microbe is then cultured and selected for compatibility to the second antibacterial agent. Any colony thus isolated is tested for compatibility to each, or both antibacterial agents to confirm compatibility with these two agents. The selection process described above can be repeated to identify isolates of the microbe that are compatible with a multitude of antifungal or antibacterial agents.

Candidate isolates can be tested to ensure that the selection for agrichemical compatibility did not result in loss of a desired microbial bioactivity. Isolates of the microbe that are compatible with commonly employed fungicides can be selected as described above. The resulting compatible microbe can be compared with the parental microbe on plants in its ability to promote germination.

Throughout the specification, the word "comprise," or variations such as "comprises" or "comprising," will be understood to imply the inclusion of a stated integer or group of integers but not the exclusion of any other integer or group of integers.

Although the present invention has been described in detail with reference to examples below, it is understood that various modifications can be made without departing from the spirit of the invention. For instance, while the particular examples below may illustrate the methods and embodiments described herein using a specific plant, the principles in these examples may be applied to any agricultural crop. Therefore, it will be appreciated that the scope of this invention is encompassed by the embodiments of the inventions recited herein and the specification rather than the specific examples that are exemplified below. All cited patents and publications referred to in this application are herein incorporated by reference in their entirety.

EXAMPLES

Example 1: Introducing *Burkholderia phytofirmans* Strain PsJN into Maize Seeds The concept of internal seed colonization with plant growth promoting microorganisms according to the present invention was tested with the endophytic bacterium *Burkholderia phytofirmans* stain PsJN and two varieties of maize. Strain PsJN was applied by spraying female flowers with a suspension of $10^8$-$10^9$ CFU mL$^{-1}$. Control seeds were either non-treated or treated with seed coating formulation for the same bacterial strain. Experiments were performed to determine the effects of internally colonized maize seeds ("endoseeds") on offspring plant biomass and vigor as compared to non-treated controls and external application of the same bacterial strain.

Experiment Description

The present invention provides seeds having beneficial microorganisms (especially bacteria) inside them, enabling improved plant biomass over controls as employing the same microorganisms applied exogenously to seeds. A variant of the bacterium *Burkholderia phytofirmans* strain PsJN chromosomally tagged with the 0-glucuronidase gene (gusA, reporter gene for detection and monitoring of the strain by color formation) was used as a test strain in to maize cultivars (Peso and Morignon). For this, a series of experiments were performed and the experimental setup was divided into two categories ($1^{st}$ and $2^{nd}$ year experiments): (A) evaluation of strain PsJN colonization potential in different tissues of maize plants (particularly grains), and (B) follow-up evaluation of strain PsJN colonized seed and strain PsJN inoculation (exogenously) to improve plant productivity over control.

Growth of PsJN Strain as Bacterial Inoculum

The bacterial strain was grown by loop-inoculating one single colony in LB broth amended with spectinomycin (100 µg mL$^{-1}$) in 100 mL flasks. The bacterial culture was incubated at 28° C. for 2 days at 180 rpm in a shaking incubator. The bacterial inoculum was applied in two different ways i.e., seed soaking and spraying inoculum at flowering stage. Maize seeds were surface sterilized by dipping for 5 and 3 min in 70% ethanol and NaOCl following 3 washings with sterilized water. There were three treatments, 1) seed inoculation 2) specific spraying of flowers and 3) seed inoculation combined with flower inoculation. Plants grown from seeds treated with sterile culture broth only served as control. For inoculation, seeds of two maize cultivars were dipped for 3-4 hours in bacterial inoculum ($10^8$-$10^9$ CFU mL$^{-1}$). Likewise, bacterial inoculum was specifically sprayed to the female flower when the crop reached flowering stage. Seeds were sown in plastic trays filled with soil and 12 day-old seedlings were transferred into 50 kg soil container (2 plants in each container) under wirehouse conditions.

Endophytic Colonization by PsJN Strain (Particularly Grain Colonization)

Figure 35:
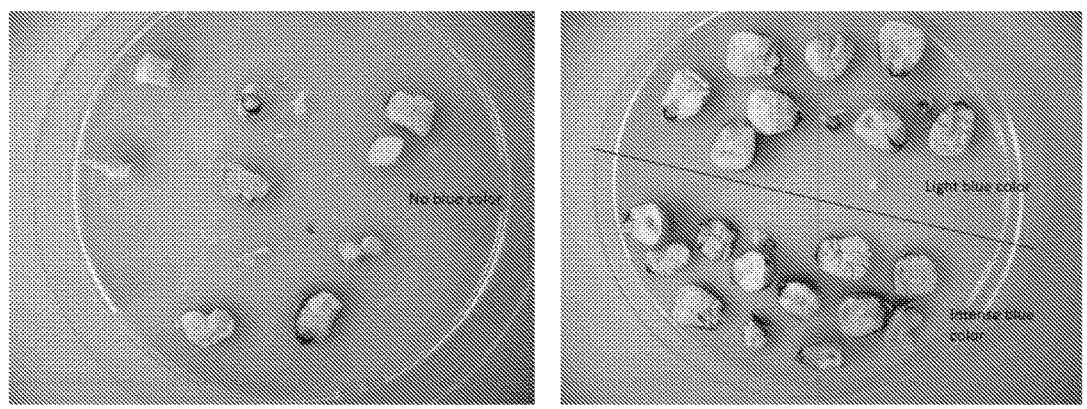
FIG. 35 shows maize colonization by PsJN (harboring expressing beta-glucuronidase) visualized through gus-staining procedure.

The rhizosphere and endophytic colonization of root, stem and leaves by the gusA-labeled variant of *B. phytofirmans* strains PsJN was determined by plate counting using LB plates amended with 5-Bromo-4-chloro-3-indolyl b-D-glucuronide (X-glcA, 50 µg mL$^{-1}$), IPTG (50 µg mL$^{-1}$) and the antibiotic spectinomycin (100 µg mL$^{-1}$). Root, stem and leaf samples were washed, surface sterilized (as described above) and used for PsJN recovery (colonization). For this, samples were crushed in 0.9% saline buffer, subjected to oscillation in a pulsifier for 30 sec and dilution series were spread on agar plates. 0-glucuronidase positive cells appear blue on media containing X-glcA. The blue colonies were counted after 3 days of incubation at 30° C. and the original cell number per g plant tissue was calculated. Similarly, PsJN colonization was also observed from different cob parts i.e., sheath, grains and cob interior (see FIG. 35). The identity of the blue colonies was further confirmed by RFLP analysis of the 16S-23S rRNA intergenic spacer region.

Follow-up experiments were performed in the $2^{nd}$ year to evaluate the (1) viability, activation and colonization ability of strain PsJN colonizing maize seeds; (2) effect of strain PsJN colonized seed on germination and seedling vigor compared to untreated control (plastic tray assay); and (3) effect of strain PsJN colonized seed on plant biomass compared to untreated control (pot trials).

Prior to the plant experiments, PsJN colonized seeds of both cultivars were tested to see whether PsJN cells are present and viable inside. For this purpose, 20 seeds were imbibed in saline buffer for 2-3 days and subsequently crushed in 0.9% saline buffer, shaken for 45 second with a pulsifier and spread in dilutions on LB plates amended with X-glcA, IPTG and spectinomycin.

Bacterial inoculum was prepared as described above and three experiments were performed with four treatments i.e., control, seed inoculation with strain PsJN (exogenously), PsJN colonized seeds (produced in $1^{st}$ year by spraying), PsJN colonized seed+inoculation.

For testing the germination performance, seeds (45) were surface sterilized and inoculated as described earlier, and were sown in a plastic tray (30 cm diameter) with three replicates. Data on time to start germination, mean germination time, time to 50% and final germination, germination index and energy, coefficient of uniform germination, and skewness were recorded of PsJN colonized over control.

Two pot experiments were performed to evaluate the performance of PsJN colonized seeds concerning plant biomass production as compared to control. Surface sterilized seeds were directly sown in pots with soil (first pot trial) or alternatively sown in plastic trays, and after 10 days seedlings were transferred to 5 kg pots ($2^{nd}$ pot trial). All plants were harvested after 60 days and data of plant height, number of leaves per plant and root-shoot biomass were recorded. The data were subjected to analyses of variance using SPSS software package version 19 (SPSS Ink, Chicago, Ill.).

Results Experiment a ($1^{st}$ Year): Seed Colonization by Strain PsJN

The ability of strain PsJN to colonize maize cobs (cob sheath, cob interior and grains) was analyzed in plants treated by specific flower inoculation (by spraying) only or by seed inoculation (FIG. 1). Only inoculation of flowers resulted in internal colonization of seeds. Internal seed colonization by strain PsJN was observed in both cultivars and both flower inoculation treatments. PsJN cells were detected in maize seeds at viable population densities that ranged from $10^2$-$10^5$ CFUg$^{-1}$ fresh weight. At maturity, PsJN cells were detected within maize seeds at viable population densities that ranged from $10^2$-$10^5$ CFU g$^{-1}$ fresh weight. Strain PsJN was not recovered from plants grown from seeds that were coated with inoculum. After 12 months of storage $10^2$ viable cells per g seeds were still recovered.

Experiment B1 (2$^{nd}$ Year): Viability, Activation and Colonization Ability of Strain PsJN Colonizing Maize Seeds.

PsJN colonized seeds, recovered from the first year experiment were tested to see whether PsJN cells survive inside dormant seed and have the ability to colonize the plants emerging from the seeds. This is very important as seeds may be stored for several months until planting in normal agriculturue. $10^2$ viable cells were detected in two months old dormant seeds (FIG. 1). Imbibing in saline buffer for 2-3 days activated the 6 month-old seeds and when the seeds began to germinate, PsJN started to proliferate resulting in a recovery of $10^4$ viable cells. Sprouts the emerged from 420 day old seeds were colonized by $10^5$ PsJN cells and the bacteria was found all over the inside the sprouts (FIGS. 2 and 3).

Experiment B2 (2$^{nd}$ Year): Effect of PsJN Colonized Seeds on Germination and Seedling Vigor as Compared to Untreated Control The data summarized in tables A and D revealed that PsJN colonized seeds showed significant improved germination ability. PsJN colonized seeds of both cultivars started to germinate 36-48 hours earlier than the control. PsJN colonized seed showed almost 100% final germination and required less mean germination time as compared to the control seeds. Consequently, the colonized seeds have better germination index as compared to control.

Moreover PsJN colonized seeds of both cultivars showed significantly higher maize seedling biomass as compared to untreated control seeds (Tables B and E; FIGS. 4 and 5) but non-significantly higher seedling biomass as compared to seeds exogenously inoculated with PsJN.

Experiment b3 (2$^{nd}$ Year): Effect of PsJN Colonized Seed on Plant Biomass Compared to Untreated Control (Pot Trials)

The data of the pot trials (Tables C and F) revealed that PsJN colonized maize seeds had a positive effect on plant biomass production comparable to seeds externally coated with PsJN cells with cv Morignon being more responsive than cv Peso in both treatments (Tables C and F). The PsJN colonized seeds showed 38% increase in plant biomass production and a significant increase in root biomass as compared to the control. Moreover, the number of leaves per plant was higher in plants of PsJN colonized seed as compared to the control.

Conclusions

*Burkholderia phytofirmans* PsJN can be introduced into maize seeds by spraying cells onto flowers.

Seed inoculation only does not allow colonization of maize seeds of the next generation.

Strain PsJN can survive inside maize seeds for at least 12 months when stored in good conditions Seed-colonizing bacterial cells are rapidly activated, proliferate and colonize emerging sprouts during germination Seed-colonizing PsJN promotes substantial plant growth promotion The present example therefore shows that the method according to the present invention enables an effective and reliable way to generate seeds with endophytes in a controlled and reproducible manner.

TABLE A

Comparative performance of PsJN colonized seed and PsJN inoculated seed (exogenously) on germination of maize cv Peso (Data presented is the average of n = 3 independent replicates.)

| Treatment | Time to Start Germination (days) | Time to 50% Germination (T50) (days) | Mean emergence Time (MET) (days) | Final Germination % (FGP) | Germination Energy (GE) | Coefficient of uniform emergence (CUE) | Germination index (GI) | Skewness |
|---|---|---|---|---|---|---|---|---|
| Control‡ | 4a† | 5.20b | 6.74a | 83.33bc | 72.92ab | 0.80NS | 6.45bc | 0.77bc |
| PsJN Inoculation‡ | 3.33ab | 4.80c | 6.55a | 100a | 85.42a | 0.67 | 8.82a | 0.73c |
| Control§ | 4a | 5.60a | 6.83a | 77.08c | 64.58b | 0.85 | 5.45c | 0.82a |
| PsJN Inoculation§ | 3.33ab | 5.30ab | 6.73a | 89.58b | 68.75ab | 0.74 | 6.85b | 0.78ab |
| PsJN colonized seed‡ | 2.33bc | 4.33d | 5.49b | 100a | 69ab | 0.77 | 8.75a | 0.79ab |

†Values sharing similar letter(s) do not differ significantly at P < 0.05, according to Duncans Multiple Range Test.

‡Seeds prepared by spraying PsJN inoculum ($10^8$-$10^9$ CFU mL$^{-1}$)

‡Parent seed used for first year experiment

§Offspring seed produced from first year experiment a, b, c, d: The letters indicate significant differences. If the values are given the same letter they do not differ significantly. If they have different letters they are significantly different from each other.

TABLE B

Comparative difference of PsJN inoculated and PsJN colonized seed on biomass of maize cv Peso in plastic tray experiment (Data presented is the average of n = 3 independent replicates.)

| Treatment | Fresh Plant biomass (g) | | | | Dry Plant biomass (g) | | | | Plant height (cm) | No. of leaves per plant |
|---|---|---|---|---|---|---|---|---|---|---|
| | Stem | Leaves | Root | Total biomass | Stem | Leaves | Root | Total biomass | | |
| Control | 79.37 c† | 95.70 b | 37.20 b | 212.27 c | 3.63 c | 9.65 b | 1.39 b | 14.67 c | 93.37 b | 6.58 c |
| PsJN Inoculation | 93.77 b | 111.03 a | 38.4 ab | 244.43 b | 4.22 b | 10.65 ab | 1.73 a | 16.90 b | 95.87 a | 7.04 b |

TABLE B-continued

Comparative difference of PsJN inoculated and PsJN colonized seed on biomass of maize cv Peso in plastic tray experiment (Data presented is the average of n = 3 independent replicates.)

| Treatment | Fresh Plant biomass (g) | | | | Dry Plant biomass (g) | | | | Plant height (cm) | No. of leaves per plant |
|---|---|---|---|---|---|---|---|---|---|---|
| | Stem | Leaves | Root | Total biomass | Stem | Leaves | Root | Total biomass | | |
| PsJN colonized seed‡ | 99.70 b | 113.33 a | 39.63 a | 251.43 ab | 4.39 b | 11.17 a | 1.79 a | 17.35 b | 97.33 a | 7.20 b |

†Values sharing similar letter(s) do not differ significantly at P < 0.05, according to Duncans Multiple Range Test.
‡Seeds prepared by spraying PsJN inoculum onto flowers($10^8$-$10^9$ CFU mL$^{-1}$)

TABLE C

Comparative performance of PsJN colonized seed and PsJN inoculation (exogenously) on plant biomass of maize cv Peso grown in pots (Data presented is the average of n = 3 independent replicates.)

| | Pot trial I (Direct sowing) | | | | Pot trial II (Nurserysowing) | |
|---|---|---|---|---|---|---|
| Treatment | Plant height (cm) | No. of leaves per plant | Shoot biomass | Root biomass | Shoot biomass | Root biomass |
| Control | 96.42 c† | 6.98 c | 5.32 c | 0.82 c | 1.29 c | 0.28 c |
| PsJN Inoculation | 108.01 ab | 9.04 ab | 8.80 ab | 1.42 a | 2.37 b | 0.423 ab |
| PsJN colonized seed‡ | 104.62 b | 8.42 b | 7.17 b | 1.12 b | 2.16 b | 0.358 b |

†Values sharing similar letter(s) do not differ significantly at P < 0.05, according to Duncans Multiple Range Test.
‡Seeds prepared by spraying PsJN inoculum onto flowers($10^8$-$10^9$ CFU mL$^{-1}$)

TABLE D

Comparative performance of PsJN colonized seed and PsJN inoculated seed (exogenously) on germination of maize cv Morignon (Data presented is the average of n = 3 independent replicates.)

| Treatment | Time to Start Germination (days) | Time to 50% Germination (T50) (days) | Mean emergence Time (MET) (days) | Final Germination % (FGP) | Germination Energy (GE) | Coefficient of uniform emergence (CUE) | Germination index (GI) | Skewness |
|---|---|---|---|---|---|---|---|---|
| Control⸸ | 4.33a† | 4.98a | 6.72a | 85.42bc | 79.17ab | 0.81NS | 6.66b | 0.74NS |
| PsJN Inoculation⸸ | 3.67a-c | 4.96a | 6.65a | 95.83ab | 89.58a | 0.78 | 8.25a | 0.75 |
| Control§ | 4ab | 5.02a | 6.65a | 79.17c | 75b | 0.74 | 6.65b | 0.76 |
| PsJN Inoculation§ | 3.33bc | 5.07a | 6.59a | 91.67ab | 75b | 0.65 | 7.88ab | 0.77 |
| PsJN colonized seed‡ | 3c | 4.10b | 5.69b | 100a | 83.33ab | 0.69 | 9.06a | 0.72 |

†Values sharing similar letter(s) do not differ significantly at P < 0.05, according to Duncans Multiple Range Test.
‡Seeds prepared by spraying PsJN inoculum ($10^8$-$10^9$ CFU mL$^{-1}$)
⸸Parent seed used for first year experiment
§Offspring seed produced from first year experiment

TABLE E

Comparative performance of PsJN colonized seed and PsJN inoculated seed (exogenously) on seedling biomass of maize cv Morignon in plastic tray experiment (Data presented is the average of n = 3 independent replicates.)

| Treatment | Fresh Plant biomass (g) | | | | Dry Plant biomass (g) | | | | Plant height (cm) | No. of Leaves perplant |
|---|---|---|---|---|---|---|---|---|---|---|
| | Stem | Leaves | Root | Total biomass | Stem | Leaves | Root | Total biomass | | |
| Control | 81.07 c† | 97.70 b | 38.43 b | 215.93 c | 3.83 c | 9.67 c | 1.76 b | 15.26 c | 94.76N | 6.53 c |
| PsJN Inoculation | 92.67 b | 104.80 a | 42.40 a | 239.23 b | 4.64 b | 10.57 b | 2.34 a | 17.67 b | 95.00 | 6.87 b |

TABLE E-continued

Comparative performance of PsJN colonized seed and PsJN inoculated seed (exogenously) on seedling biomass of maize cv Morignon in plastic tray experiment (Data presented is the average of n = 3 independent replicates.)

| Treatment | Fresh Plant biomass (g) | | | | Dry Plant biomass (g) | | | | Plant height (cm) | No. of Leaves perplant |
|---|---|---|---|---|---|---|---|---|---|---|
| | Stem | Leaves | Root | Total biomass | Stem | Leaves | Root | Total biomass | | |
| PsJN colonized seed‡ | 92.90 b | 105.07 a | 41.93 a | 240.13 b | 4.66 b | 11.25 ab | 2.35 a | 18.24 ab | 95.02 | 6.84 b |

†Values sharing similar letter(s) do not differ significantly at P < 0.05, according to Duncans Multiple Range Test.
‡Seeds prepared by spraying PsJN inoculum ($10^8$-$10^9$ CFU mL$^{-1}$)

TABLE F

Comparative performance of PsJN colonized seed vs PsJN inoculated seed (exogenously) on plant biomass of maize cv Morignon grown in pots (Data presented is the average of n = 3 independent replicates.)

| Treatment | Pot trial I (Direct sowing) | | | | Pot trial II (Nursery sowing) | |
|---|---|---|---|---|---|---|
| | Plant height (cm) | No. of leaves perplant | Shoot biomass | Root biomass | Shoot biomass | Root biomass |
| Control | 101.42 c† | 7.98 c | 6.36 c | 1.12 c | 3.29 c | 0.41 c |
| PsJN Inoculation | 110.67 b | 9.47 b | 8.17 b | 1.42 b | 4.37 b | 0.623 ab |
| PsJN colonized seed‡ | 113.01 ab | 9.83 b | 8.80 b | 1.56 ab | 4.26 b | 0.558 b |

†Values sharing similar letter(s) do not differ significantly at P < 0.05, according to Duncans Multiple Range Test.
‡Seeds prepared by spraying PsJN inoculum ($10^8$-$10^9$ CFU mL$^{-1}$)

Example 2: Introducing B. phytofirmans PsJN and Enterobacter sp. FD17 into Wheat and Barley Seeds Experiment Description Seeds of wheat (*Triticum* spp. cvs Collada and Monsun) and barley (*Hordeum vulgare* L. cvs Victoriana and Totum) were surface sterilized by dipping for 5 and 3 min in 70% ethanol and NaOCl, respectively, followed by 3 washings with sterilized water. Seeds were sown in plastic trays and 12 days old seedlings were transferred into 20 kg soil containers and grown under green-house conditions. The soil was collected from an agricultural field in Tulln, Lower Austria, and sieved to remove plant material. Bacterial strains (gusA-labelled variants of *B. phytofirmans* PsJN and *Enterobacter* sp. FD17) were grown by loop inoculation in LB broth amended with spectinomycin (100 µg mL$^{-1}$) in 100 mL Erlenmeyer flask. Bacterial cultures were incubated at 28° C. for 2 days at 180 rpm in a shaking incubator. Bacterial inoculum was applied by spraying exclusively flowers with one of the two bacterial strains. Control plants were treated with sterilized broth.

Endophytic Colonization of Wheat and Barley Seeds

Plants were harvested at ripening stage and seeds were collected. Seed colonization by the inoculant stains was determined by GUS-staining Therefore, seeds were cut in two pieces and incubated in GUS-staining solution (1 mM EDTA, 5 mM potassium ferricyanide, 5 mM potassium ferrocyanide, 100 mM sodium phosphate, pH 7.0, 1% Triton-X-100, 0.1 mg/mL X-Gluc predissolved in 5 µL/mg N,N-dimethylformamide, 0.1% IPTG) directly after harvesting at 37° C. for 20 hours. Afterwards, samples were rinsed with 70% ethanol. The ethanol was then discarded and samples were fixed in paraformaldehyde solution (4% paraformaldehyde dissolved in PBS at 60° C. with constant stirring until clarifying of the solution) overnight at 4° C. Finally, the fixed samples were rinsed 3 times in PBS and stored in the last rinse at 4° C. until further processing. In parallel, seeds were manually crushed under sterile conditions and used for bacterial community DNA isolation employing standard procedures. The presence of the inoculant strains was confirmed by sequence analysis of the 16S-23S rRNA intergenic spacer region (IGS) of single clones and subsequent comparison with those from the inoculants strains.

Results Experiment A (1$^{st}$ year):

Both seeds of wheat and barley were found to be internally colonized by the inoculants strains. Sequence analysis of the IGS-region confirmed the presence of *Enterobacter* sp. FD17 and *B. phytofirmans* PsJN.

Conclusions Example 2

*Burkholderia phytofirmans* PsJN and *Enterobacter* sp. FD17 can be introduced into barley and wheat seeds by spraying these microbes onto flowers.

Example 3: Introducing B. phytofirmans PsJN into Tomato and Pepper Seeds

Experiment A: Inoculation of Tomato and Pepper Flowers with *B. phytofirmans* PsJN::gusA110 and Detection by GUS Staining The colonization behavior of *Burkholderia phytofirmans* PsJN during transmission from flowers to seeds was studied in tomato (*Solanum lycopersicum* cv. Micro Tom and Matina) and pepper (*Capsicum annuum* cv. Feher). The presence of PsJN was investigated at 3 different timepoints. Detection of bacteria in the seed interior of harvested samples was conducted by GUS-staining and microscopy on the one hand and strain-specific quantitative PCR on the other hand. For detection by visual observation of staining and microscopy, the gusA-labelled variant of the strain PsJN, *Burkholderia phytofirmans* PsJN::gusA110, was used in parallel with the wild-strain that was detected via qPCR.

The ability of PsJN to survive in the seed and proliferate with the emerging seedling was studied in a subsequent germination experiment. The harvested seeds from the previously treated plants were sown and grown for a certain period. Afterwards the seedlings were examined regarding their presence of PsJN by GUS-staining and quantitative PCR of PsJN-specific genes.

The bacterial strains were grown by loop-inoculating one single colony in LB broth containing 0.1% of the antibiotic spectinomycin in case of *B. phytofirmans* PsJN::gusA110 and without antibiotics in case of the wild-type strain and incubated at 28° C. on a shaker (160 rpm) overnight. The overnight culture was transferred to 500 mL Erlenmeyer flasks containing 250 mL liquid LB medium. They were incubated on a shaker (120 rpm) at 28° C. for 2 days to allow for growth of bacteria. Subsequently, aliquots of 40 mL of the incubated medium containing the bacterial culture were added to 50 mL plastic tubes and centrifuged at 4500 rpm and 4° C. for 10 minutes (Megafuge 40R, Heraeus, Hanau, Germany). Afterwards, the supernatant was discarded and the bacterial pellet re-suspended by vortexing in 20 mL PBS (0.2 g/L KCl, 1.44 g/L Na2HPO4 and 0.24 g/L KH2PO4, in dH2O, pH 7.4, autoclaved). The control suspension was treated accordingly. The aliquots of each bacterial suspension were then pooled in 500 mL Schott bottles. The concentration of the suspensions was measured by spectrophotometry (NanoDrop 1000 3.7.1., Wilmington, Del., USA) and adjusted to $3 \times 10^8$ CFU/mL.

Specific inoculation of tomato and pepper flowers was conducted when the plants reached growth stage 61-63 on the BBCH scale (for tomato: first inflorescence: first flower open-third inflorescence: first flower open; for pepper: first flower open-third flower open) (Feller et al., 2001).

Figure 6:
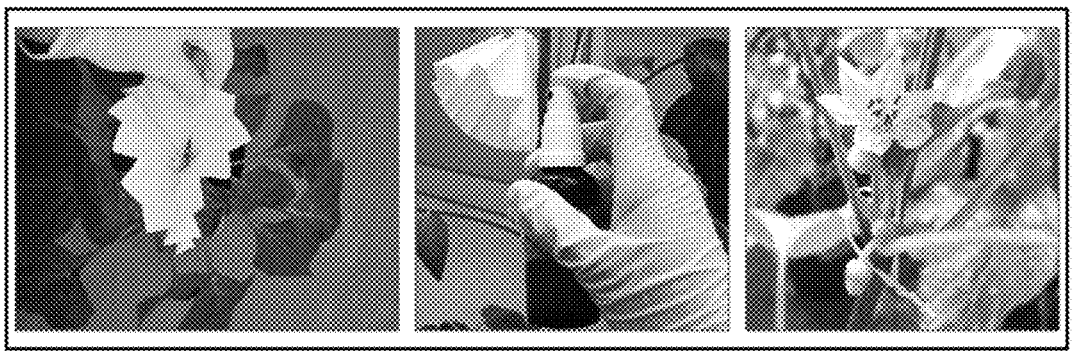
FIG. 6 shows the spraying of pepper flowers to introduce a novel microbe. Pepper flowers were shielded with a filter paper, sprayed with 675 µL bacterial suspension in a concentration of $3 \times 10^8$ CFU/mL and marked.
Figure 7:
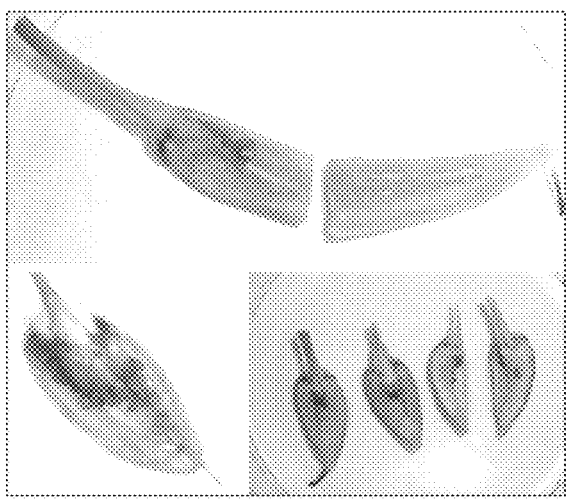
FIG. 7 shows representative results of GUS-staining in pepper treated with hormone-producing, phosphate-solubilizing PsJN that was genetically engineered with gusA110 15 days post inoculation (dpi) GUS-activity, demonstrated by blue dye accumulation, was found in all plant parts including seeds indicating the presence of PsJN inoculant (A shows GUS-activity in pericarp, peduncle, seed and placenta, B shows GUS-activity in seeds, C is negative). Not all samples tested positive (replicate number n=6).
Figure 8:
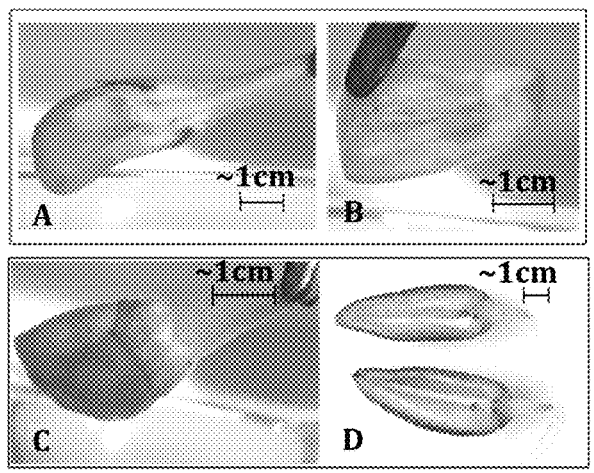
FIG. 8 shows representative result of GUS-staining of control pepper 15 dpi (images A through D). Low GUS-activity was found in peduncle (image C) and pericarp (image B and D) (replicate n=6). Generally, staining occurred less frequently than in the PsJN::gusA110 treated plants.
Figure 9:
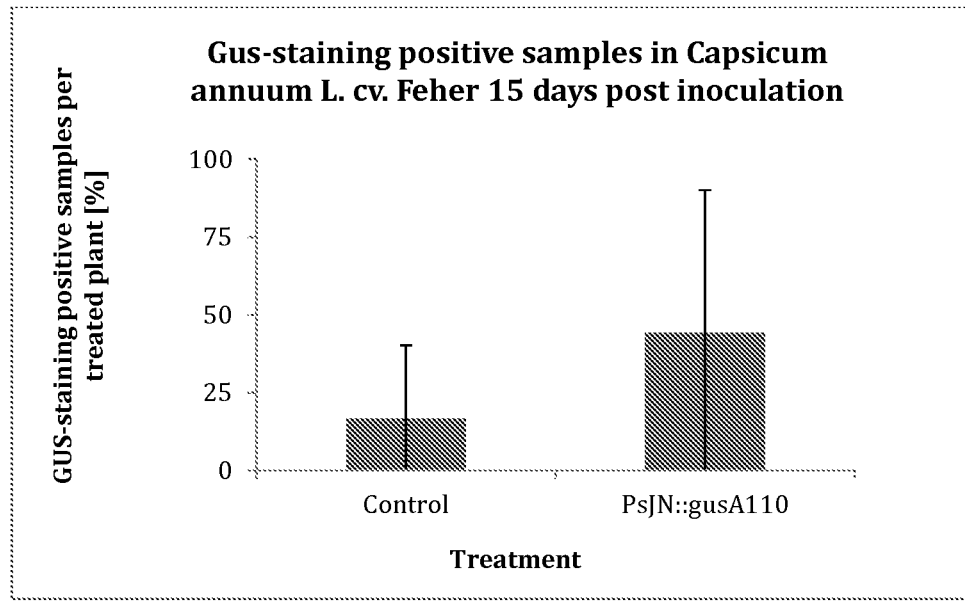
FIG. 9 shows GUS-staining positive samples in pepper 15 days post inoculation (dpi). The percentage of treated flowers/fruits per plant, which were GUS-positive in an examination 15 dpi, was 17% in the control and 46% in the PsJN::gusA110 treatment (replicate n=6)
Figure 10:
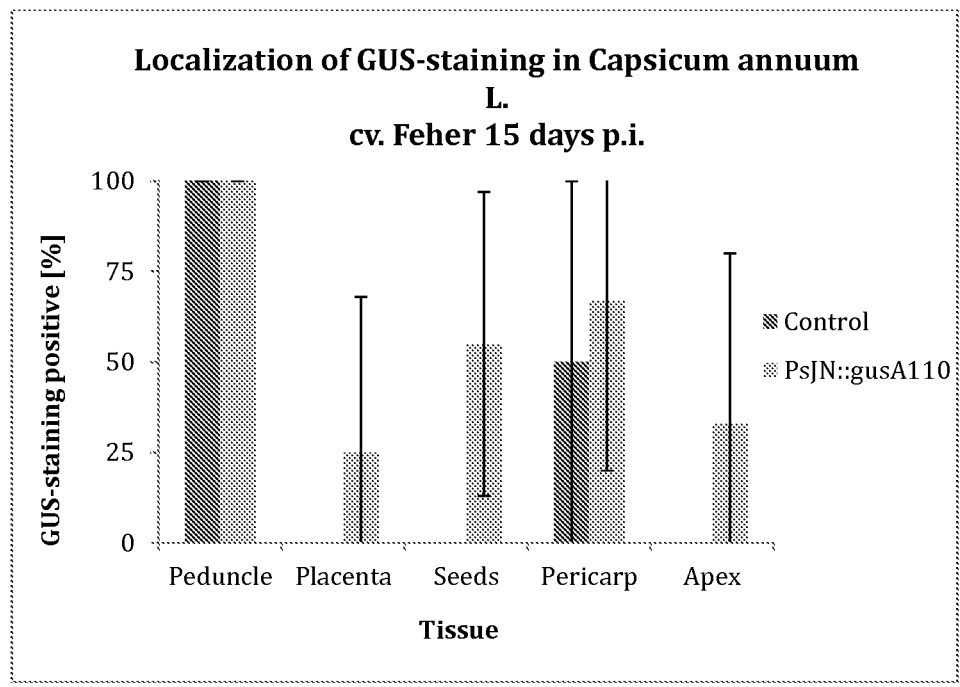
FIG. 10 shows the localization of GUS-staining in pepper 15 dpi. GUS-responsiveness in different anatomic parts examined in GUS-positive samples shows that only after PsJN::gusA110 treatment, staining can be found in placenta, seeds and apex. Staining in the control was only found in peduncle and partly in the pericarp. Differences in intensity were negligible and are not displayed.
Figure 11:
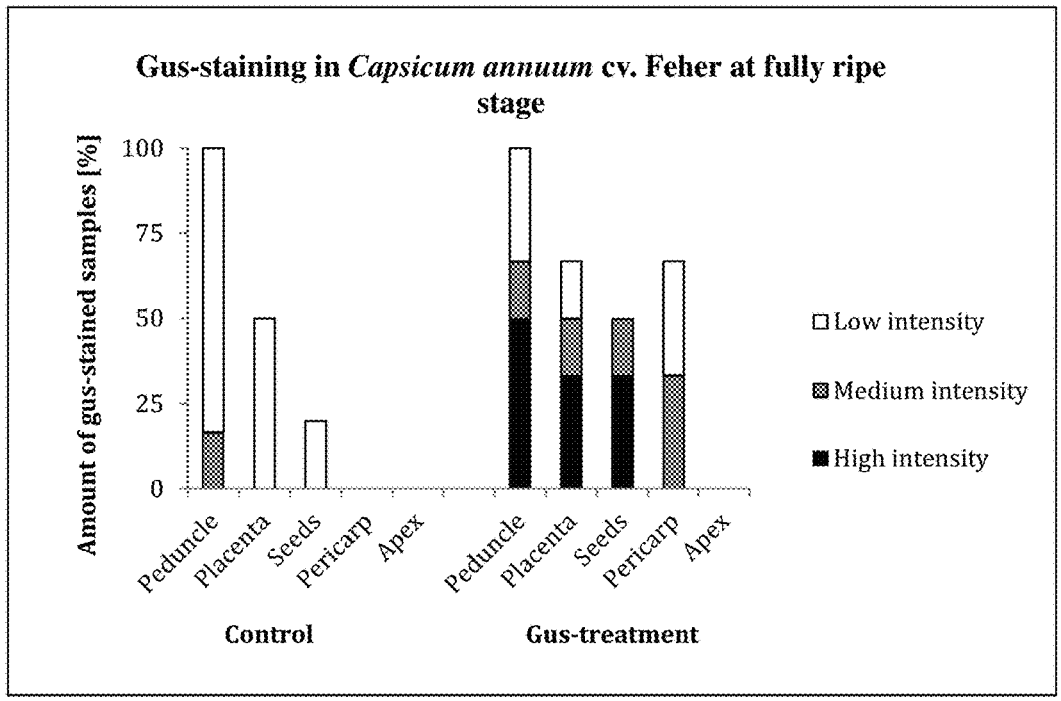
FIG. 11 shows the localization of GUS-staining in fully ripe pepper. GUS-staining was more intense and frequent in PsJN::gusA110 treated samples. Only in these, high amounts of GUS-activity are detected in peduncle, placenta and seeds.
Figure 12:
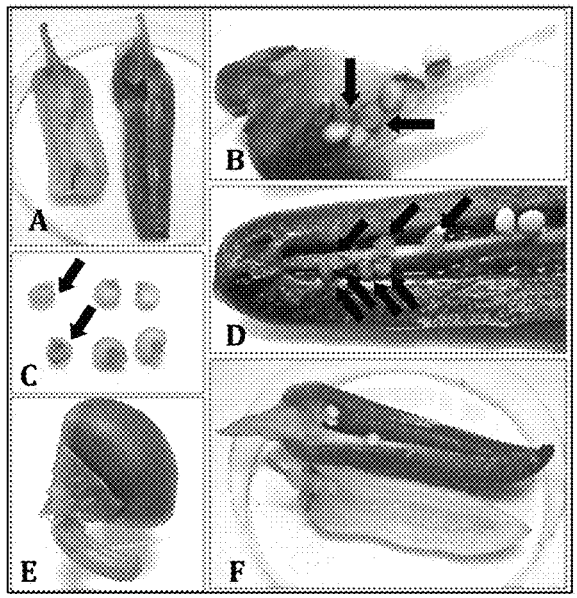
FIG. 12 shows a representative result of GUS-staining in pepper treated with PsJN::gusA110 harvested ripe. GUS-staining reached a very high intensity in 40-50% of samples and was preferably localized in peduncle (images A, B, E, F). GUS-activity was observed in about 50% of cases inside seeds as indicated by black arrows (images B, C, D). GUS-activity was also found in pericarp (images A, D, E) and placenta (images A, B, F).
Figure 13:
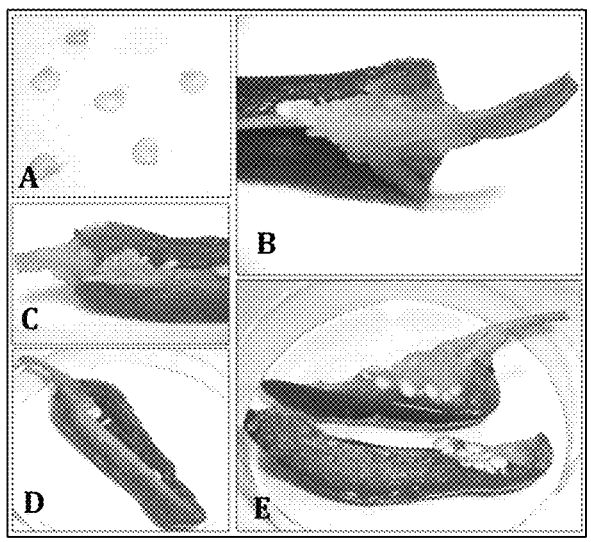
FIG. 13 shows the representative results of GUS-staining in control pepper harvested at ripe stage. GUS-staining intensity was generally weak and in most cases restricted to the peduncle (images B, C, D, E). In 50% of GUS-active samples, staining was observed in placenta (image D). Fruit sizes vary between 8-12 cm (scale bar not shown).
Figure 14:
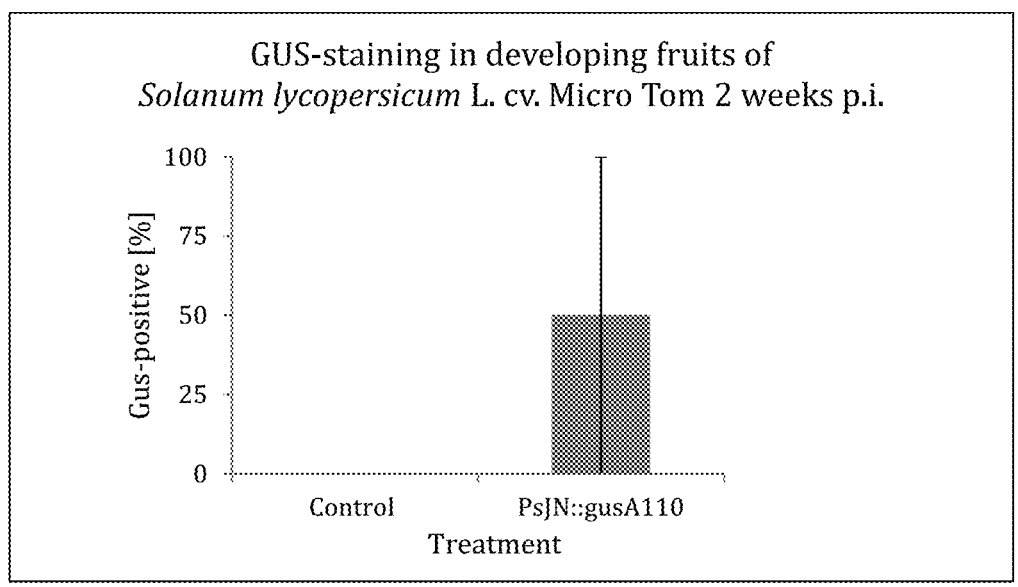
FIG. 14 shows the results of GUS-staining tomato cv. Micro Tom 2 weeks post inoculation. In 50% of sprayed inflorescences (replicates n=6), GUS-activity was observed in at least one developing fruit. No GUS-activity was observed in the control.
Figure 15:
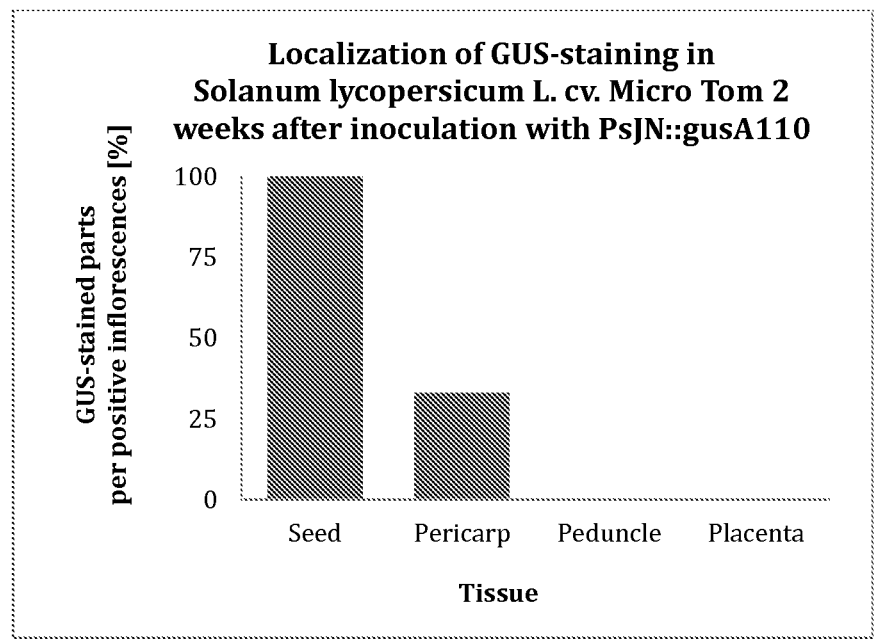
FIG. 15 shows the localization of GUS-staining in tomato cv. Micro Tom 2 weeks post inoculation. Among the positive samples of PsJN::gusA110 inoculated plants, GUS-staining was located to 100% in seeds and to 25% of in the pericarp.
Figure 16:
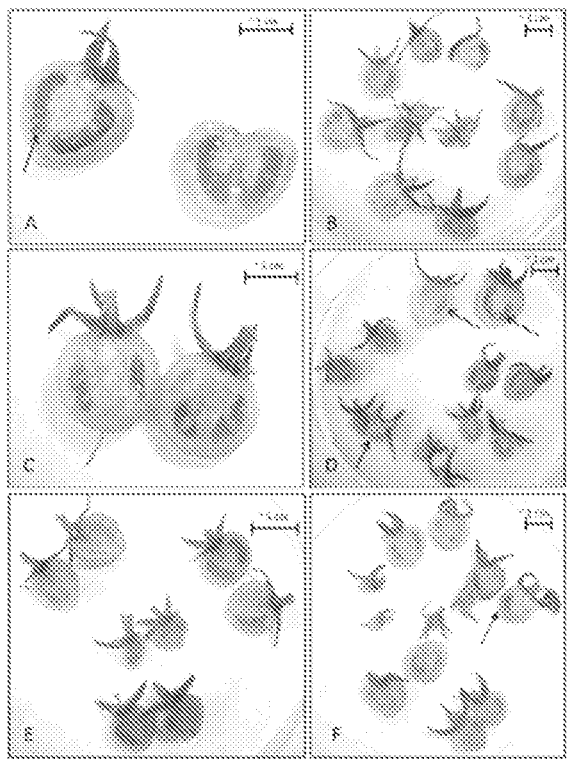
FIG. 16 shows the GUS-staining in tomato cv. Micro Tom treated with PsJN::gusA110 2 weeks post inoculation. All fruits yielded from 6 replicate inflorescences developing into different amounts of fruits are shown. Replicates A, D and F contain GUS-positive fruits.
Figure 17:
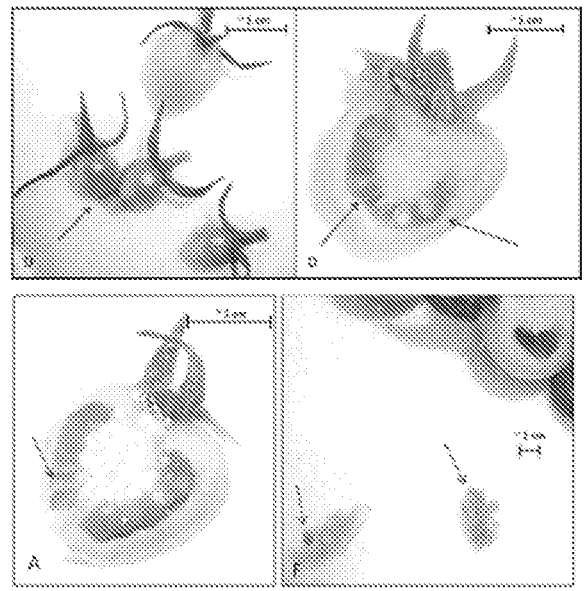
FIG. 17 shows the enlarged GUS-positive samples of tomato cv. Micro Tom 2 weeks post inoculation. Replicate D, A and F display GUS-activity in seeds. Replicate D additionally shows GUS-activity in the pericarp of two small fruits.
Figure 18:
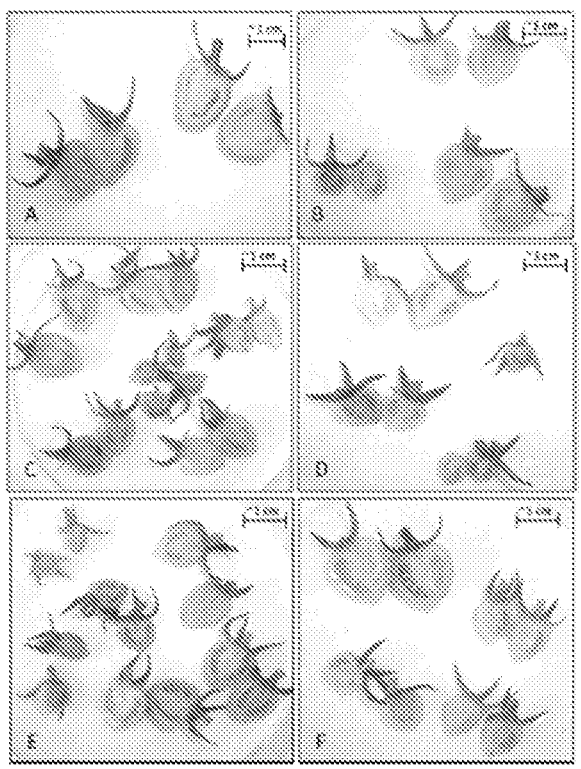
FIG. 18 shows the GUS-staining in control tomato cv. Micro Tom 2 weeks post inoculation. All 6 replicates are shown. No GUS-activity could be observed in control plants as shown by images A-F.
Figure 19:
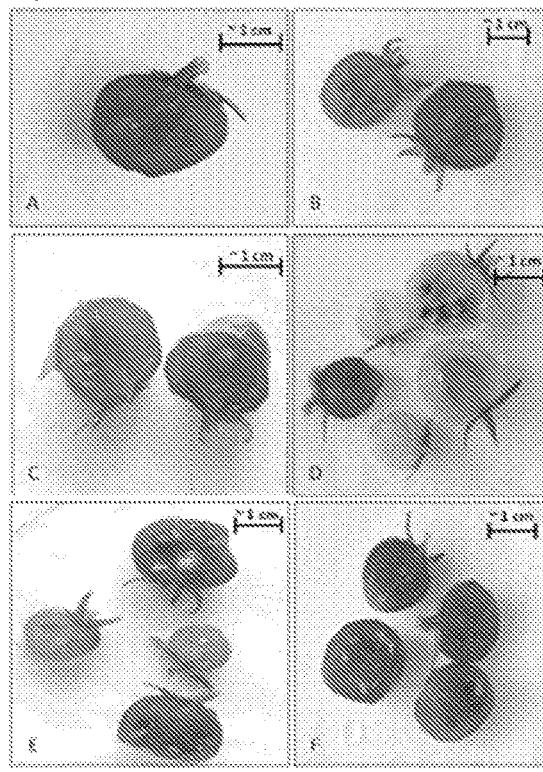
FIG. 19 shows GUS-staining in tomato cv. Micro Tom treated with PsJN::gusA110 harvested ripe. All 6 replicates are shown and consist of different amounts of fruits. GUS-staining is concentrated in seeds and placenta (Images B, D, E, F). No GUS-activity is observed in pericarp and peduncle (Images A-F).
Figure 20:
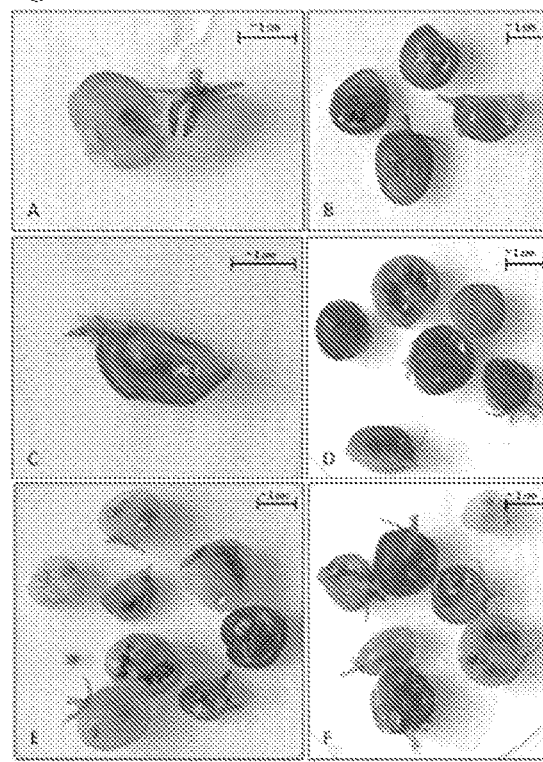
FIG. 20 shows GUS-staining in control tomato cv. Micro Tom harvested at fully ripe stage. All 6 replicates are shown and consist of different amounts of fruits. Staining is mostly found in seeds, placenta and pericarp (images B, D, E, F).
Figure 21:
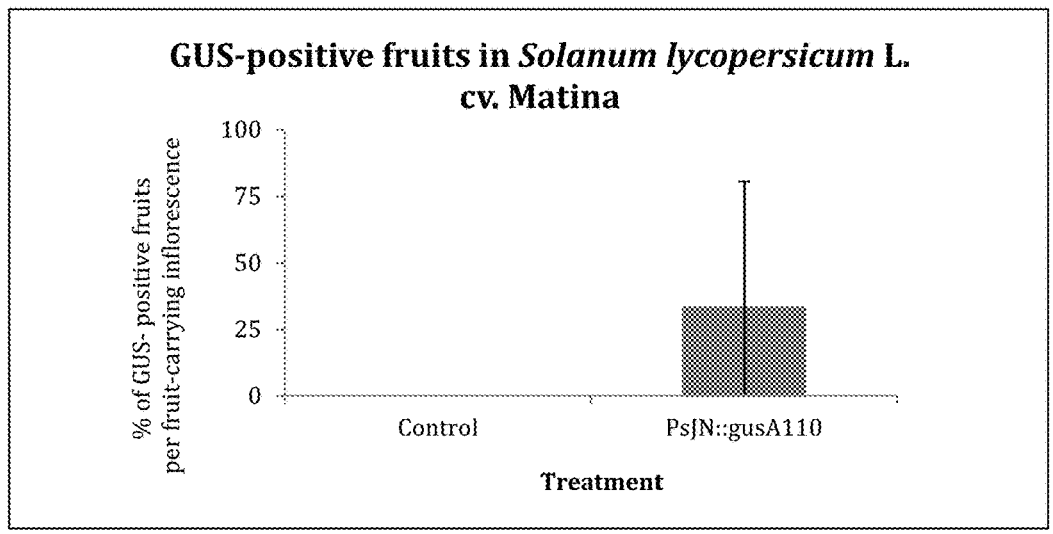
FIG. 21 shows GUS-staining in tomato cv. Matina 1 week post inoculation. Developing fruits with GUS-activity were only found in inflorescences inoculated with PsJN::gusA110. Where inflorescences had developed small fruits, 33% of them stained blue.

The bacterial inoculants and the buffer only for control were added to a 50 mL glass pump spray bottle previously sterilized with 70% ethanol. The plants to be inoculated were spatially separated from the others to avoid contamination by drift. One single flower or 2 to 3 immediately adjacent flowers were sprayed with 675 µL, of the inoculum. A filter paper was used to shield the surrounding plant parts such as leaves and stem from drift and take up surplus inoculum to avoid dripping on the soil. The treated inflorescences/flowers were marked with a twist tie to enable later identification (FIG. 6).

Six replicates of the inoculated plants were analyzed at 3 different developmental stages. Pepper samples were taken 3 days and 15 days after spraying as well as at full ripeness. The plant material (buds, flowers, fertilized flowers, developing fruits, immature fruits, ripe fruits and seeds) was cut with a sterile scalpel and subsequently incubated in GUS-staining solution (1 mM EDTA, 5 mM potassium ferricyanide, 5 mM potassium ferrocyanide, 100 mM sodium phosphate, pH 7.0, 1% Triton-X-100, 0.1 mg/mL X-Gluc predissolved in 5 µL/mg N,N-dimethylformamide, 0.1% IPTG) directly after harvesting at 37° C. for 20 hours. Afterwards, destaining was done by rinsing the samples with 70% ethanol. The ethanol was then discarded and the samples fixed in paraformaldehyde solution (4% paraformaldehyde dissolved in PBS at 60° C. with constant stirring until clarifying of the solution) overnight at 4° C. Finally, the fixed samples were rinsed 3 times in PBS and stored in the last rinse at 4° C. until further processing.

Material of plants inoculated with PsJN wild-type and control samples were immediately after harvest frozen in liquid nitrogen and transferred for storage at −80° C. Afterwards, DNA was isolated using standard procedures and used as described above for Example 2.

Results Experiment A (1$^{st}$ Year):

Upon flower spraying *B. phytofirmans* PsJN colonized seeds and pericarp of fruits of tomato and pepper. The colonization process was monitored by GUS-staining and microscopy (FIGS. 7-21). In summary, GUS-staining was found preferentially in the fruit and seeds of tomatoes and peppers that developed from flowers treated with PsJN::gusA110, but in most cases not in the ones derived from control treatments.

Experiment B: Detection of PsJN in Plant Tissues (Fruits and Seeds) Using qPCR

DNA was extracted from pepper plant material, which had been obtained at various time-points after inoculation with PsJN wild type and control inoculants or stored at −80° C. Pepper plant material was spooled in mortars separated by treatments and finely ground while constantly replenishing liquid nitrogen in order to avoid thawing. Approximately 100 mg of the pulverized samples were transferred to three 2 mL plastic tubes (free of detectable DNase, RNase and human DNA, by Greiner Bio One, Frickenhausen, Germany) and stored on liquid nitrogen until further treatment. The same was done with 6 replicate seedlings having emerged from seeds obtained from the parental generation inoculated with PsJN wild type and control. 15 seeds from the pooled replicates, which had been stored for 2 months were put in a 2 mL Eppendorf tube containing a metal ball and homogenized by help of a ball mill (Ball Mill MM31 by Retsch, Haan, Germany) at 30 Hz for 90 seconds. DNA was extracted using the CTAB method essentially as described by Stralis-Pavese, Nancy, et al., Nature protocols 6.5 (2011): 609-624. The quality and concentration of the extracted DNA was measured with a ThermoScientific NanoDrop and gel electrophoresis. Where applicable, RNA was removed by incubating the DNA suspension with 2 µL RNAse on a thermomixer at 37° C. for 1-1.5 hours.

For absolute quantification of PsJN DNA in pepper samples, a TaqMan-PCR assay was performed. A primer set (2615) specific for *Burkholderia phytofirmans* PsJN had been constructed in a previous study. The gene encoding for glutamine synthetase was the basic target for this primer set, which will allow for amplification of a fragment consisting of 84 nucleotides. The sequence of the forward primer was ATCCGTGGCCGACGTCGTGC (5'→3') (SEQ ID 1218), the sequence of the reverse primer was GCAACACGTTTCGGTGCCGGTGT (5'→3') (SEQ ID 1219). Additionally, a specific probe labeled with FAM-5' and 3'-BHQ had been developed previously, which bound to the inner part of the amplicon at a distance of 59 nucleotides from the forward primer. The sequence of this probe was TTGTCGACTTTCGTTTCACC (5'→3') (SEQ ID 1220). For a final volume of 204, (including 1 µL template) for each reaction tube, a master mix was prepared as follows:

10 µL SsoFast Probes Supermix (2× solution, by Bio-Rad)
   1 µL forward primer [100 µM]
   1 µL reverse primer [100 µM]
   1 µL probe [50 µM]
   6 µL Milli-Q H$_2$O 19 µL of the previously prepared master mix were pipetted into the wells of a 96-well PCR plate and 1 µL of the respective sample was added. The well plate was then tightly sealed with self-adhesive film and the reaction mix spun down in a centrifuge at 4° C. for 20 seconds (2000 rpm). The qPCR was run on a Bio-Rad real-time detection system CFX96 (Bio-Rad, Hercules, Calif., USA) at the following settings: Hot start at 95° C. for 2 minutes, 69 cycle denaturation at 95° C. for 5 seconds and hybridization and elongation for 20 seconds.

Figure 22:
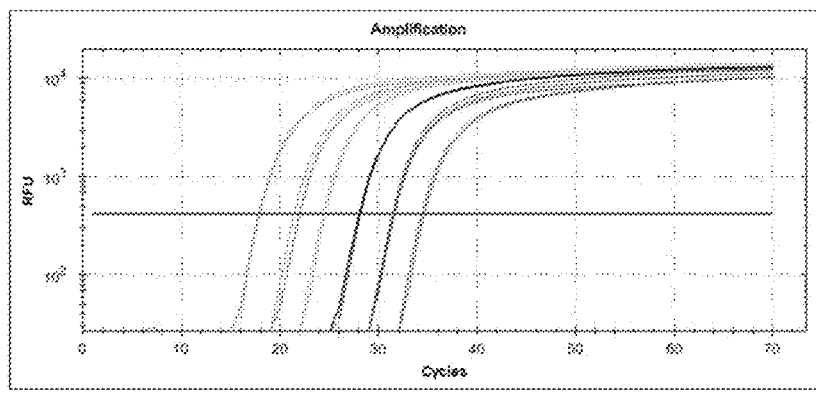
FIG. 22 shows the qPCR amplification curves of standards. The regular spaces between standard dilutions and the indistinguishability of the technical replicates reflect ideal qPCR reactions.
Figure 23:
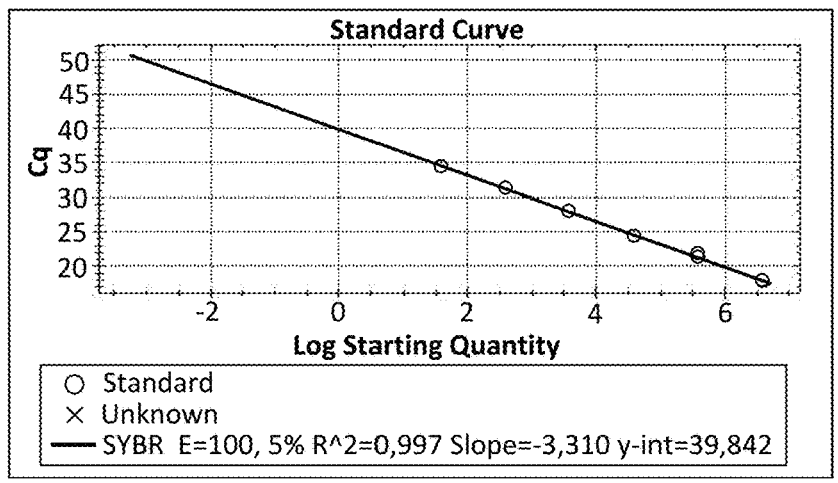
FIG. 23 shows the standard curve constructed from dilution series. The efficiency E of 100.5% and $r^2$ of 0.997 as well as a slope of −3-310 reflect ideal qPCR run.

Additionally, for absolute quantification of DNA in the pepper samples, a calibration curve was generated from the real-time qPCR results of 3 respective replicates of a 10-fold serial dilution of purified DNA (344.2 ng/µL) extracted from *B. phytofirmans* PsJN (FIGS. 22 and 23). Unknown starting quantity of DNA copy numbers in the samples could be calculated based on the standard curve from the dilution series of known concentrations, which produced an $r^2$ value of 0.997. All data analysis was performed by help of the software Bio-Rad CFX Manager 3.0.

Results Experiment B

Figure 24:
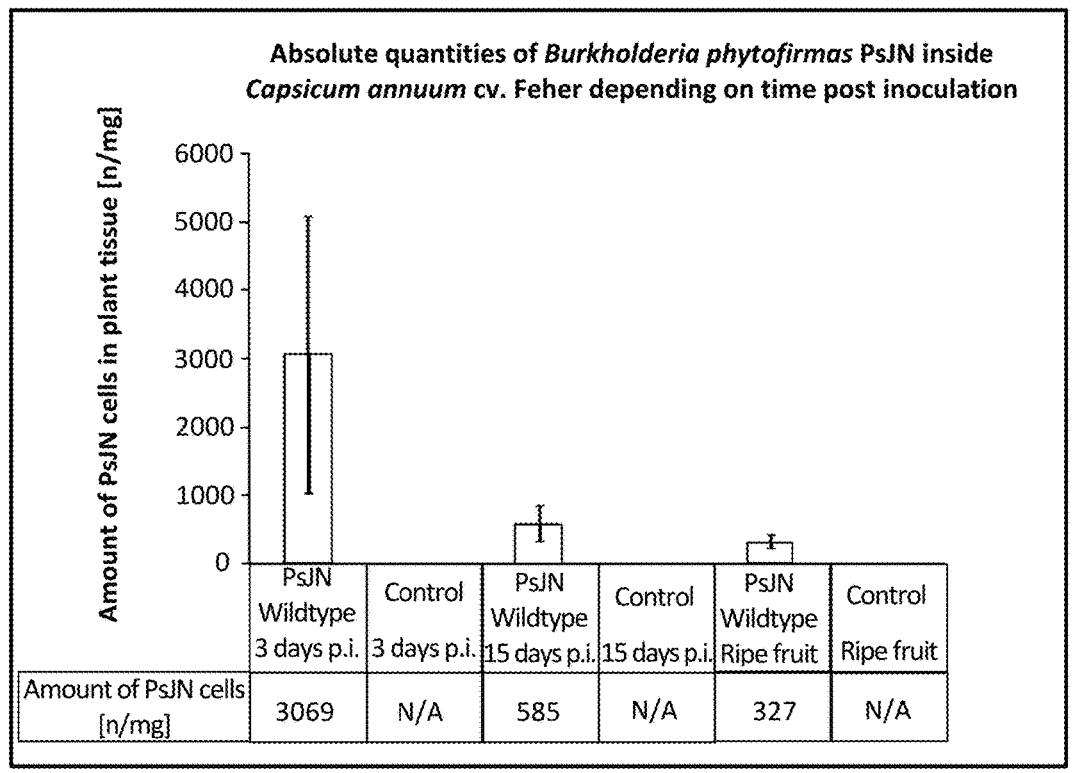
FIG. 24 shows the amount of hormone-producing, phosphate-solubilizing PsJN detected in pepper samples through qPCR. PsJN is found in samples sprayed with the bacterial inoculum at developmental stages examined. The concentration of PsJN cells in plant tissue decreases with advancing fruit growth. No PsJN is found in control plants.

The results of qPCR analysis show that 3 days after the treatment (FIG. 24), the amount of detected DNA was rather high and corresponded to 3069 cells/mg, whereas this value had steeply declined 12 days later (at 15 days p.i.) when 585 cells/mg were detected. At the final point of examination, the fully ripe stage, the amount of cells found was even less (327 cells/mg) but the decrease had not continued proportionally to the first 15 days. Although the larger amounts of PsJN detected in the first 15 days might have been due to dead bacteria left-over from the initial spray, in the ripe fruit, the absolute amount of bacterial DNA may be assigned exclusively to bacteria inside the plant tissue. It showed the lowest value of all time-points, which may be due to the dilution effect from increasing fruit size.

Gel analysis showed a clear band at the expected fragment size of 84 bp in samples treated with the PsJN wild type inoculum in all stages examined. The fragment was absent in control samples, PsJN inoculated seed samples and in the negative control. The intensity of the band was consistent with the quantification of PsJN in the sample by qPCR: Samples harvested 3 days p.i. showed the highest intensity, which declined with an increasing time interval after inoculation. However, the signal appearing in qPCR may not have derived from the amplified 84 bp fragment alone. A second band of lower fragment size appears on the gel in all samples including the negative control (therefore likely primer-dimers).

Figure 25:
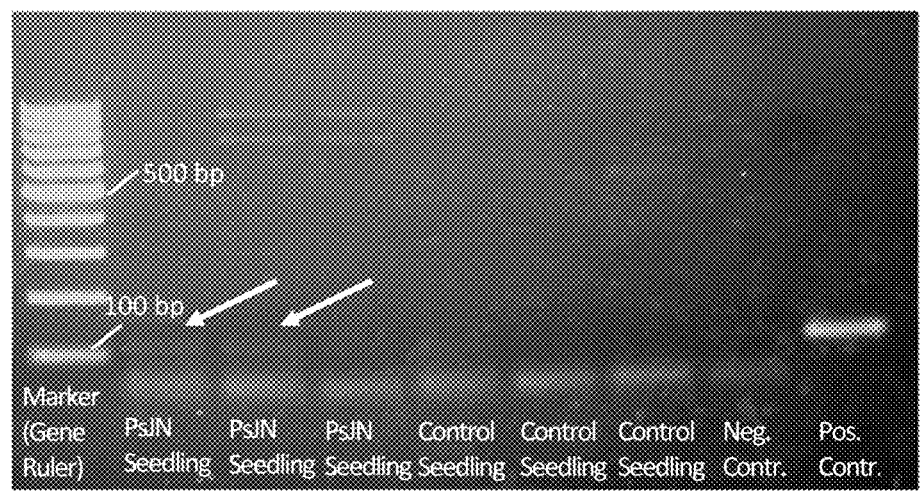
FIG. 25 shows the results of PCR of pepper samples with primer pair 2615 and gel analysis. A faint band is observed, with the same molecular size as the one in the positive control, in two replicates of DNA extracted from seedlings obtained from P inoculated with hormone-producing, phosphate-solubilizing PsJN wild type.

Concerning analysis of seed samples, which had been separated from the ripe fruits, PsJN could not be detected by qPCR due to the extreme sensitivity of this method to disturbance by impurities. It was presumably the large amount of starch stored in the seed, which impeded the PCR reaction. Purification of the extracted DNA came at the expense of DNA quantity which could not sufficiently be counteracted by re-precipitation and concentration. Therefore, DNA extracted from seedlings was amplified instead. In this case, an extremely low signal could be obtained for two of the three replicates by PCR and gel analysis (FIG. 25). However, no signal was obtained by qPCR.

Experiment C: Detection of PsJN in Pepper Plant Tissues (Seeds) Using FISH

Following the recommendations of Moter and Gael (2000), Journal of Microbiological Methods 41: 85-112, probes were designed targeting the 16S rRNA and 23S rRNA of *Burkholderia phytofirmans* strain PsJN (B.phyt23S 5'-CTC TCC TAC CAT GCA CAT AAA-3; SEQ ID 1221) and labeled with the fluorophore Cy5 at the 5'-end. FISH of pepper sections was conducted with the following reaction settings: 10% formamide, 46° C. hybridization temperature, 48° C. post-hybridization temperature. Domain-level probes (EUB338I 5'-GCT GCC TCC CGT AGG AGT-3', SEQ ID 1222; EUB338II 5'-GCA GCC ACC CGT AGG TGT-3', SEQ ID 1223; and EUB338III 5'-GCT GCC ACC CGT AGG TGT-3', SEQ ID 1224; Amann and Fuchs, 2008) labeled with FITC makes microbes appear green, while simultaneous binding of B.phyt 23S and EUB338 probes will make them appear yellow and thereby identify PsJN. Subsequent to FISH, the samples were observed under a confocal microscope (Olympus Fluoview FV1000 with multi-line laser FV5-LAMAR-2 HeNe(G)laser FV10-LA-HEG230-2) applying a 20x objective. Pictures were taken at 405 nm, 488 nm and 549 nm wavelength and merged (RGB) by the software ImageJ.

Results Experiment C

Figure 26:
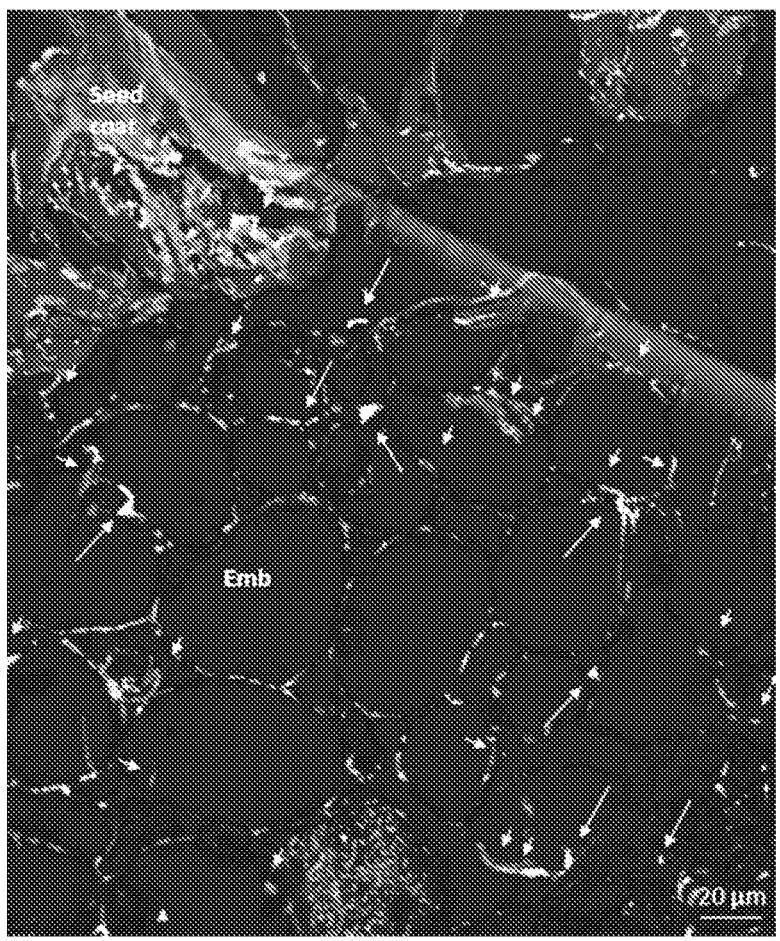
FIG. 26 shows the results of Fluorescent In Situ Hybridization (FISH) analysis of pepper seeds colonized by PsJN::gusA110 using EUB338 probe mix and probe 23S B.phyt. The general EUB338 probe mix is labeled with FITC and makes all bacteria present in the sample appear green. The PsJN specific probe 23S B.phyt is labeled with Cy5 (red fluorescence), therefore hormone-producing, phosphate-solubilizing PsJN appears yellow due to the double labeling by FITC+Cy5. Large arrows indicate PsJN, while small arrows indicate other microbes. PsJN is found in cells of the embryo (Emb), but not in the seed coat.

Yellow fluorescent bacteria PsJN were found inside the embryo along with a very large amount of other unknown bacteria (green fluorescent), which also colonized the seed coat (FIG. 26).

Experiment D: Detection of PsJN in Pepper and Tomato F1 Seedlings Using X-Gluc Staining During the sample harvesting of the fully ripe fruits, seed material for a subsequent germination experiment was gathered. In the case of tomato, seeds were collected in a fine sieve and rinsed with tap water while gently rubbing off the mucilaginous seed coat containing germination inhibiting substances. Seeds were stored for drying at room temperature (in the dark) in Petri dishes containing a filter paper to remove residual moisture. 3-4 weeks later, the seed material was transferred to 4° C. for cool treatment to break seed dormancy for germination.

The germination assay was carried out with seeds of tomato cv. Micro Tom 3 weeks after harvesting and a 24 hour period at 4° C. and with seeds of pepper 7 weeks after harvesting and a 3 week period at 4° C. In both cases, seeds were surface sterilized prior to spreading them on the growth substrate. For this, seeds of all 6 replicates of the different treatments (PsJN wild type, PsJN::gusA110, control) were pooled put in a sieve and soaked in 70% ethanol for 1 minute followed by a bath in 3.5% NaClO for 15 minutes. Afterwards, they were rinsed 6 times with dH2O. Subsequently, 25 seeds were distributed evenly on 140 mm Petri dishes containing water agar (1%, previously autoclaved). 2-3 mL dH2O were added to ensure proper imbibition of seeds. The Petri dishes were incubated at 27° C. in the dark. Seedlings were incubated in GUS-staining solution (1 mM EDTA, 5 mM potassium ferricyanide, 5 mM potassium ferrocyanide, 100 mM sodium phosphate, pH 7.0, 1% Triton-X-100, 0.1 mg/mL X-Gluc predissolved in 54/mg N,N-dimethylformamide, 0.1% IPTG) directly after harvesting at 37° C. for 20 hours. Samples were then destained by rinsing the samples with 70% ethanol, discarded, and the samples fixed in paraformaldehyde solution (4% paraformaldehyde dissolved in PBS at 60° C. with constant stirring until clarifying of the solution) overnight at 4° C. Finally, the fixed samples were rinsed 3 times in PBS and stored in the last rinse at 4° C. until further processing.

Results Experiment D

Figure 27:
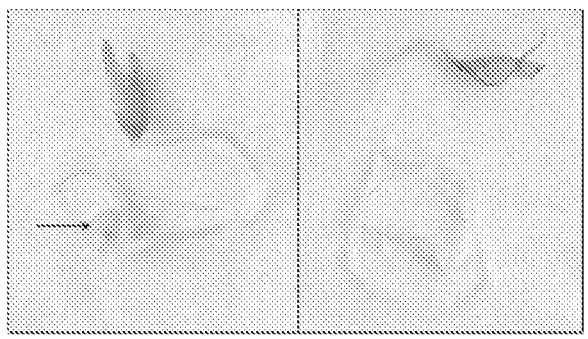
FIG. 27 shows GUS-staining in pepper seedlings (P treated with PsJN::gusA110) 4 weeks after germination. GUS-activity is below detection limit with the naked eye except in the empty seed coat. However, few stained cells (n=10-25 per seedling) were observed by microscopy in stems of seedlings. Images show a representative selection of replicates (n=6).

GUS-activity in pepper seedlings obtained from this germination experiment was below detection limit by optical examination without additional equipment. When observed under a confocal microscope (FluoView FV1000 by Olympus, Tokio, Japan) at brightfield settings, few blue cells were observed and ranged from 10-25 per seedling, mostly located in the stem. Where an empty seed coat was still attached to the seedling and was also subjected to GUS-staining, the coat was found to stain slightly blue. This observation concerned the control seedlings as well as the ones obtained from parent plants inoculated with PsJN::

gusA110. However, a meaningful quantification of GUS-activity occurring in the seed coat is not possible due to the fact that it was only in few cases still attached to the seedling. It is not unlikely though, that other endophytic bacteria not yet characterized may be present in our pepper plants and lead to the appearance of a blue background in control samples (FIG. 27).

Figure 28:
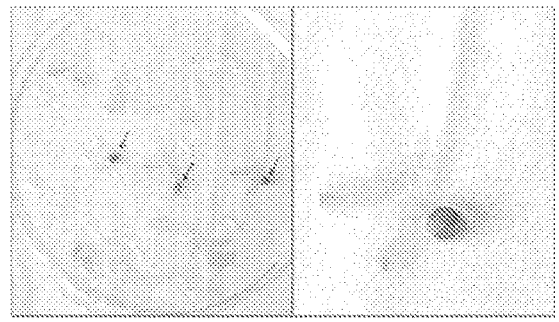
FIG. 28 shows GUS-staining in tomato cv. Micro Tom seedlings (P treated with PsJN::gusA110) 5 weeks after germination. One seedling shows GUS-activity in the tips of the cotyledons. Empty seed coats display GUS-activity

As in the case of pepper, GUS-staining of tomato seedlings was hard to detect with the naked eye except in empty seed coats of both control and PsJN::gusA110 treatment. However, in one seedling of the treated parental generation, a transition of the GUS-activity from the seed shell to the tips of the cotyledons could be observed (FIG. 28).

Experiment E: Germination of F1 Pepper and Tomato Seeds Colonized with PsJN

During the sample harvesting of the fully ripe fruits, seed material for a subsequent germination experiment was gathered. In the case of tomato, seeds were collected in a fine sieve and rinsed with tap water while gently rubbing off the mucilaginous seed coat containing germination inhibiting substances. Seeds were stored for drying at room temperature (in the dark) in Petri dishes containing a filter paper to remove residual moisture. 3-4 weeks later, the seed material was transferred to 4° C. for cool treatment to break seed dormancy for germination.

The germination assay was carried out with seeds of tomato cv. Micro Tom 3 weeks after harvesting and a 24 hour period at 4° C. and with seeds of pepper 7 weeks after harvesting and a 3 week period at 4° C. In both cases, seeds were surface sterilized prior to spreading them on the growth substrate.

For this, seeds of all 6 replicates of the different treatments (PsJN wild type, PsJN::gusA110, control) were pooled put in a sieve and soaked in 70% ethanol for 1 minute followed by a bath in 3.5% NaClO for 15 minutes. Afterwards, they were rinsed 6 times with dH2O.

Subsequently, 25 pepper and tomato seeds were distributed evenly on 140 mm Petri dishes containing water agar (1%, previously autoclaved). 2-3 mL dH2O were added to ensure proper imbibition of seeds. The Petri dishes were incubated at 27° C. in the dark. Additionally, 25 surface-sterilized seeds of pepper were spread on seed trays containing potting soil (Compo Sana Anzucht- and Kräutererde), slightly covered with potting soil, irrigated, covered with a plastic sheet and left for germination at 26° C. day temperature/22° C. night temperature in the greenhouse. This growth environment was not tested with seeds of tomato cv. Micro Tom due to a lack of seed material available. In the growth chamber as well as in the greenhouse, the germination process was constantly monitored and documented until no further germination could be observed for 3 subsequent days.

Results for Experiment E

Pepper seeds showed a similar behavior on both water agar and potting soil as a growth medium. On water agar, initial germination was observed on the 7th day after sowing and on potting soil on the 8th day. Germination of all batches was completed after 23 days on water agar, while it took only 20 days to reach the maximum germination rate in all batches on potting soil. The control seeds and the PsJN::gusA110 inoculated seeds started to germinate on both media roughly equally in time and showed overall a parallel development. PsJN::gusA110 inoculated seeds performed somewhat better under either growth conditions than the control, which was exemplified by their earlier germination when sown on water agar in comparison to the control. However the two treatments were found to meet again on the maximum level of 92% germination. On potting soil, the better performance became manifest in the constantly steep germination rate of the PsJN::gusA110 inoculated seeds until reaching the maximum, whereas the control appeared to suffer from a slight lag phase prior to reaching the same maximal value (84% of seeds germinated) as the PsJN::gusA110 inoculated seeds. The seeds obtained from parent plants inoculated with the PsJN wild type strain however showed a significant delay in their germination behavior on both growing media. While these observations strongly demonstrate that the inoculation of flowers lead to incorporation of PsJN wild type into the seed, the actual effect on the seeds is obviously not the desired one. However, despite the fact that the growth-promoting effect of *Burkholderia phytofirmans* PsJN on plants in later developmental stages has been proven in many cases, there are currently no studies available examining the effect on seeds.

Figure 29:
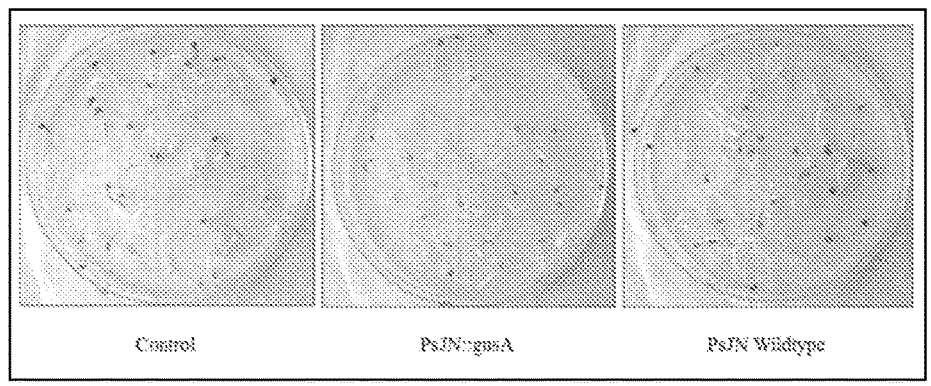
FIG. 29 shows the germination of F1 tomato cv. Micro Tom on agar plates, 7 days after sowing. No difference in germination behavior could be observed between treatments (total amount of seeds per plate=25).
Figure 30:
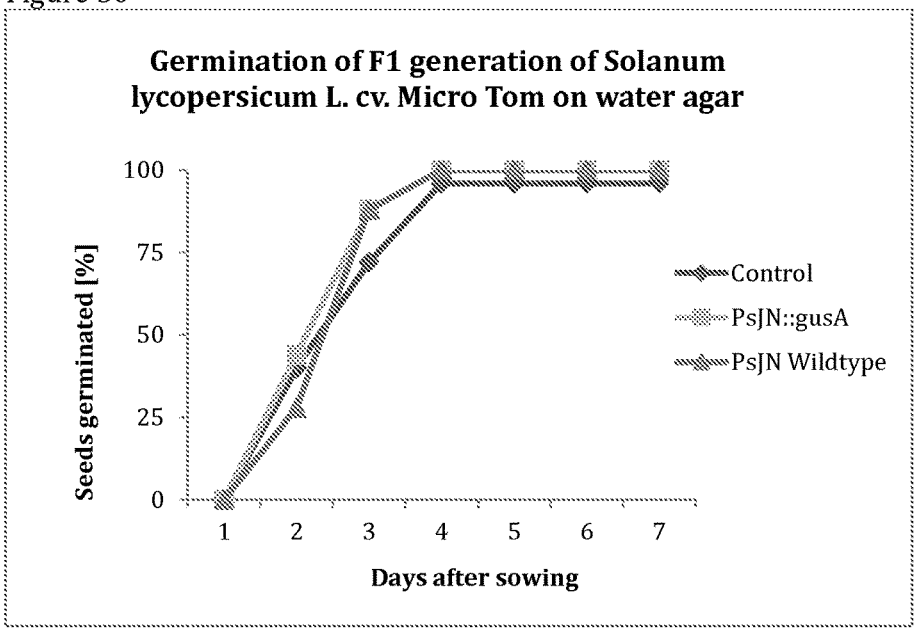
FIG. 30 shows the germination behavior of F1 tomato cv. Micro Tom on water agar. No significant difference in germination behavior can be observed between treatments. All treatments reach a germination rate of 100% (total amount of seeds per plate=25).

Due to low abundance of seed material, the germination experiment with tomato was only conducted on water agar plates (FIGS. 29 and 30). As opposed to pepper, there was no significant difference in development detectable between the treated samples and the control. This observation is in line with the detection of rather low GUS-staining 2 weeks p.i. and indistinguishable frequency/intensity of GUS-staining in the control. This finding illustrates again the fact that flower colonization of PsJN may be a crop- and cultivar-specific matter and has therefore not been as efficient in the case of tomato as in the case of pepper.

Conclusions of Example 3

*Burkholderia phytofirmans* PsJN can be introduced into tomato and pepper seeds and fruits by spraying cells onto flowers.

Example 4: Cultivation-Independent Analysis of Barley and Wheat Seed Communities Based on IGS-Region Amplicon Sequencing after Endophyte Introduction by Flower-Spray To understand changes to the endophytic microbial communities present inside of barley and wheat seeds produced by the flower-spray method described herein, DNA was extracted from the seed and was used to amplify 16 s rDNA by PCR. Amplicons were cloned and sequenced.

Experiment Description

Barley and wheat seeds obtained from Example 2, in which flowers of these plants were inoculated with strains *Enterobacter* sp. FD17 and *B. phytofirmans* PsJN were used for this example. Seeds were surface-sterilized with 70% ethanol (3 min), treated with 5% NaOHCl for 5 min, and followed by washing 3 times with sterile distilled water (1 min each time). The efficacy of surface sterilization was verified by plating seed, and aliquots of the final rinse onto LB plates. Samples were considered to be successfully sterilized when no colonies were observed on the LB plates after inoculation for 3 days at 28° C. (Naveed et al., 2013, BMC Complement Altern Med. 2013 13:265).

Surface-disinfected seeds were cut in pieces and crushed using a sterile mortar. The seed material was transferred to Matrix E (MPbio DNA isolation kit from soil) homogenized by 30 sec beat beating using in a bead beater (FastPrep FP 120, Bio101, Savant Instruments, Inc., Holbrook, N.Y.). DNA was extracted with the MPbio DNA isolation kit from soil (MP Biomedicals, Solon, Ohio, USA) according to protocol provided by the manufacturer. A single seed was used for DNA isolation.

Amplifications were performed with a thermocycler (PTC-100™, MJ Research, Inc.) the primers pHr (5'-TGCG-GCTGGATCACCTCCTT-3'; SEQ ID 1225)(Massol-Deya et al. 1995) and P23SR01 (5'-GGCTGCTTCTAAGC-CAAC-3'; SEQ ID 1226) (Massol-Deya et al. 1995). PCR-reactions (50 µl total volume) contained 10-30 ng of DNA, 1×PCR reaction buffer (Invitrogen), 1.5 mM $MgCl_2$, 0.2 µM of each primer, 0.2 mM of each deoxynucleoside triphosphate, and 2.5 U Taq DNA polymerase (LifeTech, Vienna, Austria). PCR amplifications were performed with an initial denaturation step for 5 minutes at 95° C., 30 cycles consisting of denaturation for 30 sec at 95° C., primer annealing for 30 sec at 53° C., polymerization for 1 min at 72° C., and completed by a final extension for 10 min at 72° C. PCR products (5 µl) were checked by electrophoresis in 0.8% (w/v) agarose gels (Biozym Biotech Trading, Vienna, Austria).

PCR products were purified by using a QIAquick™ PCR Purification kit (QIAGEN GmbH, Hilden, Germany). DNA fragments were ligated into the vector pSC-A-amp/kan (Strata Clone PCR Cloning Kit, Stratagene, Agilent Technologies, Santa Clara, Calif., USA) and the ligation products were transformed into competent *E. coli* cells (StrataClone SoloPack Competent Cells, Agilent Technologies, Santa Clara, Calif., USA) according to the manufacturer's instructions. One hundred clones per library, appearing as white colonies on indicator plates containing X-Gal (5-bromo-4-chloro-3-indolyl-β-D-galactopyranoside) and IPTG (isopropyl-β-thiogalactopyranoside) were picked, re-suspended in 10 µl sterile water and boiled for 5 min at 95° C. Two µl of the supernatant were used as template for PCR amplification with the primers M13f (5'-TGTAAAACGACGGCCAGT-3'; SEQ ID 1227) and M13r (5'-GGAAACAGCTATGAC-CATG-3', SEQ ID 1228) to amplify cloned inserts. PCR was performed in a total volume of 50 µl and contained in addition to the template DNA, 1×PCR reaction buffer (Invitrogen), 3 mM $MgCl_2$, 0.2 µM of each primer, 0.2 mM of each deoxynucleoside triphosphate, and 2.5 U Taq DNA polymerase (LifeTech, Vienna, Austria). Cycler conditions were as following: 5 min denaturation at 95° C., 30 cycles consisting of denaturation for 30 sec at 95° C., primer annealing for 1 min at 50° C., polymerization for 2 min at 72° C., and final extension for 10 minutes at 72° C. PCR products (5 µl) were checked by electrophoresis in 0.8% (w/v) agarose gels (Biozym Biotech Trading, Vienna, Austria.

Clones were sequenced with the primer M13r making use of the sequencing service of LGC Genomics AGOWA (Berlin, Germany). Retrieved sequences were visualized and vector sequences were removed with sequence alignment editor package of BioEdit (Ibis Biosciences, Carlsbad, Calif., USA). Sequences within a library were dereplicated and grouped using FastGroupll (http://fastgroup.sdsu.edu/fg_tools.htm). For identification representative sequences of each group were subjected to the Basic Local Alignment Search Tool (BLAST) analysis with the National Center for Biotechnology Information (NCBI) database (http://blast.ncbi.nlm.nih.gov/Blast.cgi).

Experiment Results
Wheat and Barley

Sequence analysis of the IGS-region confirmed the presence of *Enterobacter* sp. FD17 and *B. phytofirmans* PsJN. 100% of all sequences obtained after amplification, cloning, and sequencing belonged to the strain used to inoculate the barley and wheat flowers.

Example 5: Molecular and Biochemical Characterization of Maize Endophytic Bacteria The following bacterial endophytes were characterized: *Caulobacter* sp. (FA 13), *Pantoea* sp. (FF 34), *Sphinogobium* sp. (FC 42), *Pseudomonas* sp. (FB 12), *Enterobacter* sp. FD17, *Micrococus* sp. S2, *Bacillus* sp. S4, *Pantoea* sp. S6, *Actinobacter* sp. S9, *Paenibacillus* sp. S10.

Experiment Description

Bacterial strains from overnight grown cultures in TSA broth were streaked on TSA agar plates and incubated at 30° C. After 24 h, the color and shape of colonies were noted. Cell motility and shape of single colony was observed under light microscope (Nikon, Japan).

The pH limits for bacterial growth was determined adjusted to pH values between 5 and 12 in triplicate. The dependence of bacterial growth on different salt concentrations was determined in the same medium containing 1-6% NaCl. Furthermore, the ability to grow in methanol/ethanol as sole carbon source was analyzed.

Bacterial capacity to aggregate formation may positively affect their dispersal and survival in the plant environment and adsorption to plant roots. The extent of aggregation formation was measured in six replicates following the method of Madi and Henis (1989) with some modifications. Aliquots of liquid culture containing aggregates were transferred to glass tubes and allowed to stand for 30 min. Aggregates settled down to the bottom of each tubes, and the suspension was mostly composed free of cells. The turbidity of each suspension was measured at 540 nm (ODs) with a microplate reader (Synergy 5; BioTek Instrument Inc., Winooski, USA). Cultures were then dispersed with a tissue homogenizer for 1 min and the total turbidity (OD) was measured. The percentage of aggregation was estimated as follows:

$$\% \text{ aggregation}=(ODt-ODs)\times 100/ODt$$

Motility assays (swimming, swarming and twitching) were performed following the methods of Rashid and Kornberg (2000). Swim plates (LB media contained 0.3% agarose) were inoculated in triplicates with bacteria from an overnight culture on TSA agar plates grown at 30° C. with a sterile toothpick. For swarming, plates (NB media contained 0.5% agar and glucose) were inoculated with a sterile toothpick. Twitch plates (LB broth containing 1% Difco granular agar) were stab inoculated with a sharp toothpick to the bottom of petri dish from an overnight grown culture in TSA agar plates.

Biofilm formation was analyzed using overnight grown bacterial culture in 96 well microtiter plates by staining with 1% crystal violet (CV) for 45 min. To quantify the amount of biofilm, CV was destained with 200 µl of 100% ethanol. The absorbance of 150 µl of the destained CV, which was transferred into a new microtiter plate was measured at 595 nm (modified from Djordjevic et al. 2002).

Biochemical tests such as oxidase, catalase, gelatin hydrolysis and casein hydrolysis of the selected strains were performed. Oxidase and catalase activities were tested with 1% (w/v) tetramethyl-p-phenylene diamine and 3% (v/v) hydrogen peroxide solution, respectively. Gelatin and casein hydrolysis was performed by streaking bacterial strains onto a TSA plates from the stock culture. After incubation, trichloroacetic acid (TCA) was applied to the plates and made observation immediately for a period of at least 4 min (Medina and Baresi 2007).

ACC-deaminase activity of the bacterial strains was tested on Brown & Dilworth (BD) minimal medium containing 0.7 g l⁻¹ ACC as a sole nitrogen source. BD plates containing 0.7 g l⁻¹ NH4Cl served as positive control and plates without nitrogen were used as negative control. ACC deaminase activity was recorded after 7 days of incubation at 28° C.

Auxin production by bacterial isolates both in the presence and absence of L-tryptophan (L-TRP) was determined colorimetrically and expressed as IAA equivalent (Sarwar et al. 1992). Two days old bacterial cells grown (28° C. at 180 rpm) in TSA broth supplemented with 1% L-TRP solution were harvested by centrifugation (10,000 g for 10 min). Three mL of the supernatants were mixed with 2 mL Salkowski's reagent (12 g L⁻¹ FeCl₃ in 429 ml L⁻¹ H₂SO₄). The mixture was incubated at room temperature for 30 min for color development and absorbance at 535 nm was measured using spectrophotometer. Auxin concentration produced by bacterial isolates was determined using standard curves for IAA prepared from serial dilutions of 10-100 µg mL⁻¹.

Bacterial strains were evaluated for their ability to solubilize phosphates (organic/inorganic P). Aliquots (10 µL) of overnight bacterial growth culture in TSA medium were spot inoculated onto NBRI-PBP (Mehta and Nautiyal 2001) and calcium/sodium phytate agar medium (Rosado et al. 1998). Solubilization of organic/inorganic phosphates was detected by the formation of a clear zone around the bacterial growth spot. Phosphate solubilization activity may also determined by development of clear zone around bacterial growth on Pikovskaya agar medium (Pikovskaya 1948).

Bacterial isolates were assayed for siderophores production on the Chrome azurol S (CAS) agar medium described by Schwyn and Neilands (1987). Chrome azurol S agar plates were prepared and divided into half (other half filled with Minimal medium) and spot inoculated at the border of both media with bacterial isolates and incubated at 28° C. for 5 days. The CAS agar colour changed from blue to orange or purple was considered as positive for siderophore production.

For exopolysaccharide (EPS) activity (qualitative), strains were grown on Weaver mineral media enriched with glucose and production of EPS was assessed visually (modified from Weaver et al. 1975). The EPS production was monitored as floc formation (fluffy material) on the plates after 48 h of incubation at 28° C.

Strains were tested for the production of ammonia (NH₃) in peptone water as described by Cappuccino and Sherman (1992). The bacterial isolates were screened for the production of hydrogen cyanide (HCN) by inoculating King's B agar plates amended with 4.4 g L⁻¹ glycine (Lorck 1948). Filter paper (Whatman no. 1) saturated with picrate solution (2% Na₂CO₃ in 0.5% picric acid) was placed in the lid of a petri plate inoculated with bacterial isolates. The plates were incubated at 28±2° C. for 5 days. HCN production was assessed by the color change of yellow filter paper to reddish brown.

The bacterial isolates were tested for PHB production (qualitative) following the viable colony staining methods using Nile red and Sudan black B (Liu et al. 1998; Spiekermann et al. 1999). The LB plates with overnight bacterial growth were flooded with 0.02% Sudan black B for 30 min and then washed with ethanol (96%) to remove excess strains from the colonies. The dark blue colored colonies were taken as positive for PHB production. Similarly, LB plates amended with Nile red (0.54 mL⁻¹) were exposed to UV light (312 nm) after appropriate bacterial growth to detect PHB production. Colonies of PHA-accumulating strains showed fluoresce under ultraviolet light.

The bacterial strains were tested for AHL production following the method modified from Cha et al. (1998). The LB plates containing 40 µg ml⁻¹ X-Gal were plated with reporter strains (*A. tumefaciens* NTL4.pZLR4). The LB plates were spot inoculated with 10 µL of bacterial culture and incubated at 28° C. for 24 h. Production of AHL activity is indicated by a diffuse blue zone surrounding the test spot of culture. *Agrobacterium tumefaciens* NTLI (pTiC58ΔaccR) was used as positive control and plate without reporter strain was considered as negative control.

Bacterial hydrolyzing activities due to amylase, cellulase, chitinase, lipase, pectinase, protease and xylanase were screened on diagnostic plates after incubation at 28° C. Amylase activity was determined on agar plates following the protocol Männistö and Häggblom (2006). Formation of an opaque halo around colonies indicated lipase activity. Cellulase and xylanase activities were assayed on plates containing (per liter) 5 g of carboxymethyl cellulose or birch wood xylan, 1 g of peptone and 1 g of yeast extract. After 10 days of incubation, the plates were flooded with gram's iodine staining and washing with 1M NaCl to visualize the halo zone around the bacterial growth (modified from Teather and Wood 1982). Chitinase activity of the isolates was determined as zones of clearing around colonies following the method of Chernin et al. (1998). Protease activity was determined using 1% skimmed milk agar plates, while lipase activity was determined on peptone agar medium. Formation of halo zone around colonies was used as indication of activity (Smibert and Krieg 1994). Pectinase activity was determined on nutrient agar supplemented with 5 g L⁻¹ pectin. After 1 week of incubation, plates were flooded with 2% hexadecyl trimethyl ammonium bromide solution for 30 min. The plates were washed with 1M NaCl to visualize the halo zone around the bacterial growth (Mateos et al. 1992).

The antagonistic activities of bacterial isolates were screened against plant pathogenic bacteria (*Agrobacterium tumefaciens, Pseudomonas syringae, Escherichia coli, Staphylococcus aureus*), fungi (*Fusarium caulimons, Fusarium graminarium, Fusarium oxysporum, Fusarium solani, Rhizoctonia solani, Thielaviopsis basicola*) and oomycetes (*Phytophthora infestans, Phytophthora citricola, Phytophthora cominarum*). For antibacterial assays, the bacterial isolates and pathogen were cultivated in TSA broth at 30° C. for 24 h. The bacterial isolates were spot-inoculated (10 µL aliquots) on TSA plates pre-seeded with 100 µL tested pathogen. The plates were incubated at 28° C. for 48 h and clear zones of inhibition were recorded.

Antagonistic activity of the bacterial isolates against fungi and oomycetes was tasted by the dual culture technique on potato dextrose agar (PDA) and yeast malt agar (YMA) media (Dennis and Webster 1971). A small disk (5 mm) of target fungus/oomycetes was placed in the center of petri dishes of both media. Aliquots of 104 of overnight bacterial cultures grown in TSA were spotted 2 cm away from the center. Plates were incubated for 14 days at 24° C. and zones of inhibition were scored.

Strains were tested for tolerance towards selected heavy metals using TSA agar plates with the addition of 110 mg L-1 Cd (Cd NO3), 320 mg L-1 Cu (Cu SO4), 250 mg L-1 Cr (Cr NO3), 660 mg L-1 Pb (Pb (NO3)2), 110 mg L-1 Ni (Ni SO4) or 320 mg L-1 (Zn SO4). The plates were incubated at 28° C. for 5 days and metals tolerance was observed in terms of bacterial growth.

RNAse Activity Assay 1.5 g of torula yeast RNA (#R6625, Sigma) is dissolved in 1 mL of 0.1 M $Na_2HPO_4$ at pH 8, filter sterilized and added to 250 mL of autoclaved R2A agar media which is poured into 150 mm plates. The bacteria from a glycerol stock plate are inoculated using a flame-sterilized 96 pin replicator, and incubated at 25° C. for 3 days. On day three, plates are flooded with 70% perchloric acid (#311421, Sigma) for 15 minutes and scored for clear halo production around colonies.

Results of Example 5

A range of bacterial characteristics known to contribute to plant growth promotion, stress tolerance or biocontrol was tested. The results of characterization are summarized in Tables G and H.

Auxin is an important plant hormone, which can promote cell enlargement and inhibit branch development (meristem activity) in above ground plant tissues, while below ground it has the opposite effect, promoting root branching and growth. Interestingly, plant auxin is manufactured above ground and transported to the roots. It thus follows that plant and especially root inhabiting microbes which produce significant amounts of auxin will be able to promote root branching and development even under conditions where the plant reduces its own production of auxin. Such conditions can exist for example when soil is flooded and roots encounter an anoxic environment which slows or stops root metabolism. All F-strains showed IAA production (ranging from 1.63 to 10.33 µg $mL^{-1}$ IAA-equivalent) but with variable degrees of efficacy.

Siderophores are small, high-affinity iron chelating compounds secreted by microorganisms such as bacteria, fungi and grasses. They bind to the available form of iron $Fe^{3+}$ in the rhizosphere, thus making it unavailable to the phytopathogens and protecting the plant health (Ahmad et al. 2008, Microbiol Res 163:173-181, incorporated herein by reference). Siderophores are known for mobilizing Fe and making it available to the plant. Siderophore production by bacteria on a plant surface or inside a plant may both show that a microbe is equipped to grow in a nutrient limited environment, and perhaps protect the plant environment from invasion by other, perhaps undesirable microbes. Several of the strains, including FA13, FF34, FC42, FB12, FD17, S4 and S10 were found to produce significant levels of siderophore when tested in agar medium containing Chrom azurol S (CAS).

Bacterial survival and colonization in the plant environment are necessary for plant growth and yield. Recently, Zúñiga and colleagues (2013), Mol Plant-Microbe Interact 26:546-553 (incorporated herein by reference) described that the cell-to-cell communication (QS) system mediated by AHL is implicated in rhizosphere competence and colonization of *Arabidopsis thaliana* by *B. phytofirmans* PsJN. Motility, aggregate stability, and biofilm formation are important traits for root surface colonization (Danhorn and Fuqua 2007, Annu Rev Microbiol 61:401-422, incorporated herein by reference). Three strains (FB12, S6 and S10) were found to produce AHL. It should be noted, however, that the bacteria described here may have other communication systems. Aggregation and biofilm formation were common traits in all tested strains. In the case of motility, six strains (FA13, FF34, FB12, FD17, S6 and S10) were positive for swimming, while FD17, S6 and S10 also showed swarming.

Bacteria were tested for production of exopolysaccharide (EPS) and poly-hydroxybutyrate (PHB). Bacterial EPS and PHB have been shown to provide protection from such environmental insults as desiccation, predation, and the effects of antibiotics (Gasser et al. 2009, FEMS Microbiol Ecol 70:142-150; Staudt et al. 2012, Arch Microbiol 194: 197-206, each of which is incorporated by reference). They can also contribute to bacterial aggregation, surface attachment, and plant-microbe symbiosis (Laus et al. 2005, Mol Plant-Microbe Interact 18:533-538, incorporated herein by reference). Five strains (FF34, FB12, FD17, S2 and S6) showed PHB production, while FA13, FC42, FD17 and S10 were found to produce EPS.

Volatile compounds such as ammonia and HCN produced by a number of *rhizobacteria* were reported to play an important role in biocontrol (Brimecombe et al. 2001, In: Pinton R, Varanini Z, Nannipieri P (Eds.) The Rhizosphere, Marcel Dekker, New York, pp 95-140, incorporated herein by reference). Production of ammonia was commonly detected in all selected isolates but S4 and S10. In contrast, only *Pseudomonas* sp. strain FB12 was able to produce HCN.

Plant stress reactions are strongly impacted by the plant's own production and overproduction of the gaseous hormone ethylene. Ethylene is metabolized from its precursor 1-aminocyclopropane-1-carboxylate (ACC) which can be diverted from ethylene metabolism by microbial and plant enzymes having ACC deaminase activity. As the name implies, ACC deaminase removes molecular nitrogen from the ethylene precursor, removing it as a substrate for production of the plant stress hormone and providing for the microbe a source of valuable nitrogen nutrition. This microbial ability to inhibit ethylene production is very important for plant health as damage to growth and productivity under various stress conditions is believed to result from the plant's own over-production of ethylene (Saleem et al. 2007, Journal of Industrial Microbiology & Biotechnology 34(10): 635-648). ACC deaminase activity was found in FD17, FF34, FB12, S2, S4, S6, S9 and S10.

To summarize other characteristics that were tested, FD17, FF34, FB12, S6 and S10 showed P-solubilization, whereas only FD17 showed production. Only FB 12 was able to produce HCN. Strain S2 was the only strain not to show lipase activity. S10 was positive for amylase activity, S2 and S4 showed protease activity, and pectinase activity was observed with strains S6, S10, FF34, FB12 and FD17. All strains but FF34 and S9 were positive for cellulase and xylanase activity. Chitinase was produced by strains FB12, FD17 and S4. All strains showed antagonistic activity against one or more bacterial pathogens. All strains showed antagonism against different fungal pathogens and oomycetes but with FD17 and FB 12 having higher degrees of efficacy. Strain FD17 showed highest antagonism against *F. caulimons, F. solani* and *P. citricola*.

TABLE G

Physico-chemical and growth-promoting characteristics of maize seed-associated endophytic bacteria *Enterobacter* sp. (FD17), *Agrobacterium* sp. (FA13), *Pantoea* sp. (FF34), *Sphingobium* (FC42), *Pseudomonas* sp. (FB12) and *Micrococcus* sp. (S2).

| Characteristics | *Enterobacter* sp. (FD17) | *Agrobacterium* sp. (FA13) | *Pantoea* sp. (FF34) | *Sphingobium* sp. (FC42) | *Pseudomonas* sp. (FB12) | *Micrococcus* sp. (S2) |
|---|---|---|---|---|---|---|
| TPhenotypic and physiological characterization | | | | | | |
| Colony color | Creamy white | Grey | Yellow | Yello | Grey | Creamy |
| Colony morphology | Round | Round | Round | Round | Round | Round |
| Bacterial growth conditions[a] | | | | | | |
| NaCl | | | | | | |
| 2% | + | + | + | + | + | + |
| 6% | + | − | + | − | − | + |
| pH | | | | | | |
| 5 | + | + | + | + | + | + |
| 12 | + | + | − | − | + | + |
| Motility/chemotaxis[b] | | | | | | |
| Swimming | +++ | + | + | − | ++ | − |
| Swarming | + | − | − | − | − | − |
| Twitching | + | + | + | − | + | − |
| Biofilm formation | | | | | | |
| OD (600 nm) | 0.95 ± 0.04 | 0.92 ± 0.04 | 059 ± 0.02 | 0.95 ± 0.08 | 0.57 ± 0.08 | n.d. |
| Biofilm (595 nm) | 0.83 ± 0.06 | 0.23 ± 0.02 | 0.22 ± 0.03 | 0.08 ± 0.01 | 0.08 ± 0.04 | n.d. |
| Aggregate stability (%) | 40.22 ± 1.99 | 35.91 ± 2.57 | 26.07 ± 0.88 | 32.61 ± 2.13 | 36.38 ± 1.48 | n.d. |
| Biochemical characterization[a] | | | | | | |
| Catalase | + | + | + | + | + | + |
| Oxidase | − | − | − | − | + | − |
| Casein | − | − | − | − | + | − |
| Gelatin | + | − | + | − | + | + |
| Methanol | − | + | − | − | + | + |
| Ethanol | − | + | − | − | + | + |
| Growth promoting characterization[b] | | | | | | |
| ACC-deaminase | +++ | − | ++ | − | ++ | + |
| Auxin production (IAA equivalent, $\mu g\ mL^{-1}$) | | | | | | |
| without L-TRP | 7.54 ± 1.02 | 1.74 ± 0.18 | 10.33 ± 0.35 | 4.89 ± 0.78 | 1.63 ± 0.65 | − |
| with L-TRP | 12.30 ± 0.98 | 16.13 ± 1.05 | 95.34 ± 2.14 | 38.41 ± 1.78 | 7.26 ± 1.05 | − |
| P-solubilization (inorganic/organic P) | | | | | | |
| $Ca_3(PO_4)_2$ | +++ | − | ++ | − | + | − |
| $CaHPO_4$ | +++ | ++ | ++ | − | + | − |
| $Ca(H_2PO_4)_2$ | +++ | n.d. | n.d. | n.d. | n.d. | n.d. |
| Ca-phytate | +++ | − | ++ | − | ++ | − |
| Na-phytate | +++ | − | ++ | − | ++ | − |
| Exopolysaccharide | + | ++ | − | + | − | − |
| HCN production | − | − | − | − | + | − |
| $NH_3$ production | + | + | + | + | + | + |
| Siderophore production | +++ | +++ | + | + | ++ | n.d. |
| AHL | − | − | − | − | + | − |
| PHB | + | − | + | − | + | + |
| Enzyme hydrolyzing activity[b] | | | | | | |
| Amylase | − | − | − | − | − | − |
| Cellulase | ++ | + | − | + | + | + |
| Chitinase | + | − | − | − | + | − |
| Hemolytic | + | + | + | − | + | n.d. |
| Lipase | ++ | ++ | + | + | +++ | − |
| Pectinase | + | − | + | − | + | − |

TABLE G-continued

Physico-chemical and growth-promoting characteristics of maize seed-associated endophytic bacteria *Enterobacter* sp. (FD17), *Agrobacterium* sp. (FA13), *Pantoea* sp. (FF34), *Sphingobium* (FC42), *Pseudomonas* sp. (FB12) and *Micrococcus* sp. (S2).

| Characteristics | *Enterobacter* sp. (FD17) | *Agrobacterium* sp. (FA13) | *Pantoea* sp. (FF34) | *Sphingobium* sp. (FC42) | *Pseudomonas* sp. (FB12) | *Micrococcus* sp. (S2) |
|---|---|---|---|---|---|---|
| Phosphatase | +++ | − | ++ | − | ++ | − |
| Protease | − | − | − | − | − | + |
| Xylanase | ++ | + | − | +++ | + | + |
| Heavy metal resistance (mg mL$^{-1}$)‡ | | | | | | |
| Cadmium nitrate | 120 (++) | 120 (++) | 120 (+) | − | 120 (−) | − |
| Copper sulphate | 330 (−) | 330 (+) | − | 330 (+) | 330 (−) | − |
| Chromium nitrate | 250 (++) | 250 (+) | 250 (+) | 250 (+) | 250 (+) | 250 (+) |
| Lead nitrate | 660 (++) | 660 (+) | 660 (+) | 660 (+) | 660 (+) | 660 (−) |
| Nickel sulphate | 110 (+) | 110 (+) | 110 (+) | − | − | 110 (−) |
| Zinc sulphate | 330 (+) | 330 (+) | 330 (+) | 330 (+) | − | 330 (−) |
| Antagonistic activities against plant pathogenic bacteria, fungi and oomycetes[b] | | | | | | |
| Anti-bacterial activity | | | | | | |
| *A. tumefaciens* | + | − | − | − | ++ | − |
| *P. syringae* | + | − | − | − | +++ | − |
| *E. coli* | n.d. | n.d. | n.d. | n.d. | n.d. | + |
| *S. aureus* | − | − | − | − | + | + |
| Anti-fungal activity | | | | | | |
| *F. caulimons* | +++ | ++ | + | + | ++ | − |
| *F. graminarium* | ++ | + | + | + | + | − |
| *F. oxysporum* | ++ | + | ++ | + | ++ | + |
| *F. solani* | +++ | ++ | + | ++ | ++ | − |
| *R. solani* | ++ | + | + | + | ++ | + |
| *T. basicola* | + | + | + | + | ++ | − |
| Anti-oomycete activity | | | | | | |
| *P. infestans* | ++ | + | + | + | ++ | − |
| *P. citricola* | +++ | + | + | + | ++ | − |
| *P. cominarum* | ++ | + | + | + | + | − |

Results are obtained from 4-6 replicates
[a]−, absent; +, present
[b]+, low efficiency; ++, medium efficiency; +++, high efficiency

TABLE H

Physico-chemical and growth promoting characteristics of maize seed-associated endophytic bacteria *Bacillus* sp. S4, *Pantoea* sp. S6, *Actinobacter* sp. S9, and *Paenibacillus* sp. S10

| Characteristics† | *Bacillus* sp. S4 | *Paenibacillus* sp. S10 | *Pantoea* sp. S6 | *Actinobacter* sp. S9 |
|---|---|---|---|---|
| Phenotypic and physiological characterization | | | | |
| Colony color | Off-white | Creamy white | Yellow | White |
| Colony morphology | Round | Round | Round | Round |
| Gram reaction | positive | negative | Negative | Negative |
| Bacterial growth conditions* | | | | |
| Temperature | | | | |
| 4° C. | + | + | + | + |
| 42° C. | − | − | − | − |
| NaCl | | | | |
| 2% | + | + | + | + |
| 6% | + | + | + | − |
| pH | | | | |
| 5 | + | + | + | + |
| 12 | − | + | + | − |
| Motility/chemotaxis‡ | | | | |
| Swimming | − | ++ | + | − |
| Swarming | − | + | ++ | − |
| Twitching | + | + | + | − |
| Biofilm formation | | | | |
| OD (600 nm) | n.d. | n.d. | n.d. | n.d. |
| Biofilm (595 nm) | n.d. | n.d. | n.d. | n.d. |
| Aggregate stability (%) | n.d. | n.d. | n.d. | n.d. |
| Biochemical characterization* | | | | |
| Catalase | + | + | + | + |
| Oxidase | + | + | − | − |

TABLE H-continued

Physico-chemical and growth promoting characteristics of maize seed-associated endophytic bacteria Bacillus sp. S4, Pantoea sp. S6, Actinobacter sp. S9, and Paenibacillus sp. S10

| Characteristics[†] | Bacillus sp. S4 | Paenibacillus sp. S10 | Pantoea sp. S6 | Actinobacter sp. S9 |
|---|---|---|---|---|
| Casein | + | − | − | − |
| Gelatin | − | − | + | − |
| Methanol | − | + | − | + |
| Ethanol | − | + | − | + |
| Growth promoting characterization[‡] | | | | |
| ACC-deaminase activity | + | + | + | + |
| Auxin production (μg mL$^{-1}$) | | | | |
| Without L-TRP | − | − | − | − |
| With L-TRP | − | − | − | − |
| P-solubilization (Inorganic/organic P) | | | | |
| Ca3(PO4)$_2$ | − | + | + | − |
| CaHPO4 | − | + | + | − |
| Ca(H$_2$PO$_4$)$_2$ | n.d. | n.d. | n.d. | n.d. |
| Ca-Phytate | − | + | + | − |
| Na-Phytate | − | + | + | − |
| Exopolysaccharide | − | + | − | − |
| N2-fixation | − | + | + | − |
| HCN production | − | − | − | − |
| NH$_3$ production | − | − | + | + |
| Siderophore | + | + | n.d. | − |
| AHL | − | + | + | − |
| PHB | − | + | + | − |
| Enzyme hydrolyzing activity[‡] | | | | |
| Amylase | − | + | − | − |
| Cellulase | + | + | − | − |
| Chitinase | + | − | − | − |
| Hemolytic | n.d. | n.d. | n.d. | n.d. |
| Lipase | + | + | + | + |
| Pectinase | − | + | + | − |
| Phosphatase | − | + | + | − |
| Protease | + | − | − | − |
| Xylanase | + | + | + | − |
| Heavy metal resistance (mg mL$^{-1}$)[‡] | | | | |
| Cadmium nitrate | 120 (+) | − | − | − |
| Copper sulphate | 330 (+) | − | − | 330 (−) |
| Chromium nitrate | 250 (+) | 250 (+) | 250 (+) | 250 (+) |
| Lead nitrate | 660 (+) | 660 (+) | 660 (++) | 660 (+) |
| Nickel sulphate | 110 (+) | 110 (+) | 110 (+) | 110 (+) |
| Zinc sulphate | 330 (+) | 330 (+) | − | − |
| Antagonistic activities against plant pathogenic bacteria, fungi and oomycetes[‡] | | | | |
| Anti-bacterial activity | | | | |
| A. tumefaciens | + | + | − | − |
| E. coli | + | + | − | − |
| P. syringae | + | + | − | − |
| S. aureus | + | + | + | + |
| Anti-fungal and Oomycete | | | | |
| F. caulimons | + | + | + | − |
| F. graminarium | − | + | + | + |
| F. oxysporum | + | − | + | − |
| F. solani | + | + | − | − |
| R. solani | + | + | + | + |
| T. basicola | + | + | + | − |
| Anti-Oomycete | | | | |
| P. infestans | − | − | + | − |
| P. citricola | − | + | + | + |
| P. cominarum | + | + | + | + |

[†]Results in characterization table are of 4-6 replicates
*−, absent; +, present
[‡]+, low efficiency; ++, medium efficiency; +++, high efficiency Example 6: Isolation and Characterization of Additional Endophytes In order to identify additional endophytes that may be used to produce endoseeds, endophytic microbes from seeds of commercially significant grass plants were isolated and characterized.

Diverse types of maize, wheat, rice, and other seeds were acquired and screened for cultivatable microbes. 49 distinct cultivars of maize and teosinte accessions were sourced from the USDA via GRIN (National Genetic Resources Program at the world wide web at ars-grin.gov/) or purchased from the Sustainable Seed Company (Covelo, Calif.). Similarly, 5 distinct wheat cultivars and wheat relatives were sourced from the USDA via GRIN (National Genetic Resources Program at the world wide web at ars-grin.gov/) or purchased from a Whole Foods in Cambridge, Mass. Seeds of rice and rice relatives (23 in total) were sourced from the USDA via GRIN (National Genetic Resources Program at the world wide web at ars-grin.gov/) or purchased from a Whole Foods in Cambridge, Mass. Seeds of several other species of plants, including sorghum, millet, oat, rye, teff, etc., were sourced from the USDA via GRIN (National Genetic Resources Program at the world wide web at ars-grin.gov/), the Sustainable Seed Company or purchased from a Whole Foods in Cambridge, Mass. Pools of 5 seeds were soaked in 10 mL of sterile water contained in sterile 15 mL conical tubes for 24 hours. Some maize and rice accessions were sampled for seed surface microbes. In these cases, after 24 hours of soaking, 50 μL aliquots of undiluted, 100× dilute and 10000× dilute soaking water was plated onto R2A agar [Proteose peptone (0.5 g/L), Casamino acids (0.5 g/L), Yeast extract (0.5 g/L), Dextrose (0.5 g/L) Soluble starch (0.5 g/L), Dipotassium phosphate (0.3 g/L), Magnesium sulfate 7H$_2$O (0.05 g/L), Sodium pyruvate (0.3 g/L), Agar (15 g/L), Final pH 7±0.2 @ 25° C.] to culture oligotrophic bacteria, while the same volumes and dilutions were also plated onto potato dextrose agar (PDA) [Potato Infusion from 200 g/L, Dextrose 20 g/L, Agar 15 g/L, Final pH: 5.6±0.2 at 25° C.] to culture copiotrophic bacteria and fungi. All seeds in the study were sampled for endophytes by surface sterilization, trituration, and culturing of the mash. Seeds were surface sterilized by washing with 70% EtOH, rinsing with water, then washing with a 3% solution of sodium hypochlorite followed by 3 rinses in sterile water. All wash and rinse steps were 5 minutes with constant shaking at 130 rpm. Seeds were then blotted on R2A agar which was incubated at 30° C. for 7 days in order to confirm successful surface sterilization. Following the sterilization process, batches of seeds were ground with a sterile mortar and pestle in sterile R2A broth, while seeds of maize, rice and soy were also grown in sterile conditions and the roots or shoots of seedlings (without further sterilization) were crushed by bead beating in a Fastprep24 machine with 3 carbide beads, 1 mL of R2A broth in a 15 mL Falcon tube shaking at 6M/s for 60 seconds. Extracts of surface washes, crushed seed, or macerated seedling tissue were serially diluted by factors of 1 to $10^{-3}$ and spread onto quadrants on R2A, PDA, LGI or V8 juice agar in order to isolate cultivable seed-borne microorganisms. Plates were incubated at 28° C. for 7 days, monitoring for the appearance of colonies daily. After a week, plates were photographed and different morphotypes of colonies were identified and labeled. These were then selected for identification by sequencing, backing up by freezing at −80 C as glycerol stock, and assaying for beneficial functions as described herein.

Plating and Scoring of Microbes

After 7 days of growth, most bacterial colonies had grown large and distinct enough to allow differentiation based on colony size, shape, color and texture. Photographs of each plate were taken, and on the basis of color and morphotype, different colonies were identified by number for later reference. These strains were also streaked out onto either R2A or PDA to check for purity, and clean cultures were then scraped with a loop off the plate, resuspended in a mixture of R2A and glycerol, and frozen away in quadruplicate at −80° C. for later.

In-Vitro Testing of Bacterial Endophytes

A total of 242 seed-origin bacterial endophytes representing 44 distinct OTUs as described above were seeded onto 96 well plates and tested for various activities and/or production of compounds, as described below. Colonies or wells with no detectable activity were scored as "−", low activity as "1," moderate activity as "2" and strong activity as "3." The results of these in vitro assays are summarized in Table I.

TABLE I

Functional assays to examine the potential for seed-origin microbes to confer novel functions to crops.

| Sym Strain ID | SEQ ID NO: | Habitat origin | Taxonomy | Antagonizes E. coli | Antagonizes S. cerevsciae | Shows Cellulolytic activity | Shows Pectinolytic activity | Secretes siderophores | Phosphate Solubilization | Growth on N Free LGI | ACC Deaminase Activity | Produces Auxin/Indoles | Produces Acetoin |
|---|---|---|---|---|---|---|---|---|---|---|---|---|---|
| SYM00033 | 779 | Mexico, Mexico | Enterobacter sp. | 2 | — | 1 | 1 | 1 | 2 | — | — | 3 | — |
| SYM00173 | 780 | Louisiana, USA | Pantoea sp. | 1 | — | 1 | 1 | — | 2 | Yes | — | 3 | 1 |
| SYM00176 | 781 | India | Pantoea sp. | — | — | 1 | 1 | 2 | 2 | — | — | 2 | 1 |
| SYM00605 | 782 | Ancash, Peru | | — | — | — | — | 2 | 2 | — | — | 1 | — |
| SYM00607 | 783 | Ancash, Peru | | — | — | 1 | 1 | 2 | 2 | — | 1 | 1 | 2 |
| SYM00608 | 784 | Ancash, Peru | Pantoea sp. | — | — | — | — | 1 | 1 | — | — | 2 | 1 |
| SYM00620 | 785 | Ancash, Peru | Enterobacter sp. | 1 | 1 | 1 | 1 | — | 2 | — | 1 | 2 | 2 |
| SYM00658 | 786 | Holot Yavne, Israel | | — | 1 | 2 | 2 | — | — | — | 1 | 2 | 3 |
| SYM00660 | 787 | Holot Yavne, Israel | Pseudomonas sp. | — | — | — | — | 1 | 1 | — | — | — | 1 |
| SYM00011 | 788 | Durango, Mexico | Pseudomonas sp. | — | — | — | — | — | 1 | Yes | — | 2 | — |
| SYM00011b | 789 | Durango, Mexico | Pseudomonas sp. | — | — | — | — | 2 | 1 | — | — | — | 1 |
| SYM00013 | 790 | Durango, Mexico | Pseudomonas sp. | — | — | 2 | 2 | 2 | — | Yes | — | 2 | — |
| SYM00014 | 791 | Durango, Mexico | Pseudomonas sp. | — | — | 2 | 2 | 2 | 1 | Yes | — | 2 | — |
| SYM00062 | 792 | Michoacan, Mexico | Pseudomonas sp. | — | — | 2 | 2 | 1 | — | — | 1 | 2 | — |
| SYM00068 | 793 | Michoacan, Mexico | Pseudomonas sp. | — | — | 2 | 2 | 2 | 1 | — | 3 | 2 | — |
| SYM00069 | 794 | Michoacan, Mexico | Pseudomonas sp. | — | — | 2 | 2 | 2 | — | — | — | — | 2 |
| SYM00646 | 795 | Segou, Mali | Pseudomonas sp. | — | — | 2 | 2 | 3 | — | — | 3 | 2 | — |
| SYM00649 | 796 | Segou, Mali | Pseudomonas sp. | — | — | 2 | 2 | 1 | 1 | — | 3 | 2 | — |
| SYM00650 | 797 | Segou, Mali | Pseudomonas sp. | — | 1 | 2 | 2 | — | — | — | 3 | 2 | — |
| SYM00657 | 798 | Holot Yavne, Israel | Pseudomonas sp. | — | — | 2 | 2 | 2 | 1 | — | 3 | 1 | 3 |
| SYM00672 | 799 | Valle, Honduras | Pseudomonas sp. | — | — | 3 | 3 | — | — | — | — | — | 1 |
| SYM00709 | 800 | Guandong, China | Pseudomonas sp. | — | — | — | — | — | — | — | — | — | — |
| SYM00013b | 801 | Durango, Mexico | Curtobacterium sp. | — | — | 1 | 1 | 2 | — | — | — | 1 | 1 |
| SYM00167 | 802 | Unknown | Curtobacterium sp. | — | — | — | — | — | — | — | — | 1 | — |
| SYM00171 | 803 | Louisiana, USA | Curtobacterium sp. | — | — | — | — | — | — | — | — | 1 | — |
| SYM00174 | 804 | Unknown | Curtobacterium sp. | — | — | 1 | 1 | 1 | — | — | — | — | 1 |
| SYM00178 | 805 | Guandong, China | Curtobacterium sp. | — | — | — | — | — | — | — | — | — | — |
| SYM00180 | 806 | Guandong, China | Curtobacterium sp. | — | — | 1 | 1 | — | — | — | — | — | 2 |
| SYM00181 | 807 | Guandong, China | Curtobacterium sp. | — | — | — | — | — | — | — | — | 3 | 3 |
| SYM00235 | 808 | Louisiana, USA | Curtobacterium sp. | 2 | — | 1 | 1 | — | 1 | Yes | — | — | 1 |
| SYM00244 | 809 | | Curtobacterium sp. | — | — | — | — | — | — | — | — | 2 | 1 |
| SYM00525 | 810 | Rangoon, Myanmar | Curtobacterium sp. | — | — | 2 | 2 | — | — | — | — | 1 | — |
| SYM00625 | 811 | Indiana, USA | Curtobacterium sp. | — | — | 1 | 1 | 3 | — | — | 3 | 1 | 3 |
| SYM00645 | 812 | Segou, Mali | Curtobacterium sp. | — | — | — | — | — | — | — | — | — | 1 |
| SYM00647 | 813 | Segou, Mali | Curtobacterium sp. | — | — | 1 | 1 | — | — | — | — | 1 | — |
| SYM00690 | 814 | Hunan, China | Curtobacterium sp. | — | — | — | — | — | — | — | — | 1 | 1 |
| SYM00691 | 815 | Hunan, China | Curtobacterium sp. | — | — | 1 | 1 | — | — | — | 1 | 1 | — |
| SYM00693 | 816 | Hunan, China | Curtobacterium sp. | — | — | — | — | — | — | — | — | — | 1 |
| SYM00712 | 817 | Guandong, China | Curtobacterium sp. | — | — | 1 | 1 | — | — | — | — | — | — |
| SYM00716 | 818 | Louisiana, USA | Curtobacterium sp. | — | — | — | — | — | — | — | — | 1 | — |
| SYM00722 | 819 | Louisiana, USA | Curtobacterium sp. | — | — | 1 | 1 | — | — | — | 1 | 1 | 1 |
| SYM00731B | 820 | Louisiana, USA | Curtobacterium sp. | — | — | — | — | — | — | — | — | 1 | — |
| SYM00784 | 821 | Thailand | Curtobacterium sp. | — | — | 1 | 1 | — | 1 | — | — | 1 | — |
| SYM00188 | 822 | USA | Paenibacillus sp. | — | — | — | — | — | — | — | — | — | 2 |
| SYM00190 | 823 | USA | Paenibacillus sp. | — | — | — | — | — | — | — | — | — | — |

TABLE I-continued

Functional assays to examine the potential for seed-origin microbes to confer novel functions to crops.

| Sym Strain ID | SEQ ID NO: | Habitat origin | Taxonomy | Antagonizes E. coli | Antagonizes S. cereviscae | Shows Cellulolytic activity | Shows Pectinolytic activity | Secretes siderophores | Phosphate Solubilization | Growth on N Free LGI | ACC Deaminase Activity | Produces Auxin/ Indoles | Produces Acetoin |
|---|---|---|---|---|---|---|---|---|---|---|---|---|---|
| SYM00195 | 824 | USA | Paenibacillus sp. | — | — | — | — | — | 2 | — | — | — | 2 |
| SYM00217 | 825 | Unknown | Paenibacillus sp. | — | — | — | — | — | 2 | — | 1 | — | — |
| SYM00227 | 826 | Unknown | Paenibacillus sp. | — | — | 1 | 1 | — | 1 | — | — | — | 3 |
| SYM00597 | 827 | Peru | Paenibacillus sp. | — | — | — | — | — | 1 | — | — | — | — |
| SYM00017b | 828 | Arkansas, USA | Pantoea sp. | — | — | 1 | 1 | — | 2 | — | — | 3 | — |
| SYM00018 | 829 | USA | Pantoea sp. | — | — | 1 | 1 | 1 | 1 | — | — | 2 | — |
| SYM00020 | 830 | USA | Pantoea sp. | — | — | 1 | 1 | 1 | — | Yes | — | 3 | — |
| SYM00022 | 831 | Guererro, Mexico | Pantoea sp. | — | — | 1 | 1 | 1 | — | — | — | 2 | 1 |
| SYM00025 | 832 | USA | Pantoea sp. | — | — | 1 | 1 | 1 | 2 | — | — | 2 | 1 |
| SYM00043 | 833 | USA | Pantoea sp. | — | — | 1 | 1 | 1 | 2 | Yes | — | 1 | 1 |
| SYM00047 | 834 | USA | Pantoea sp. | — | — | 1 | 1 | 1 | — | — | — | — | 1 |
| SYM00049 | 835 | USA | Pantoea sp. | — | — | 1 | 1 | 1 | 2 | — | — | 3 | 1 |
| SYM00055 | 836 | USA | Pantoea sp. | — | — | 1 | 1 | 1 | — | — | — | — | 1 |
| SYM00057 | 837 | USA | Pantoea sp. | — | — | — | — | — | — | — | — | — | 3 |
| SYM00058 | 838 | USA | Pantoea sp. | — | — | 1 | 1 | 1 | 2 | Yes | — | 3 | — |
| SYM00078 | 839 | Columbia | Pantoea sp. | 3 | 1 | 1 | 1 | 1 | 2 | Yes | — | 1 | 1 |
| SYM00081 | 840 | USA | Pantoea sp. | — | — | 1 | 1 | 1 | — | Yes | — | 1 | — |
| SYM00082a | 841 | USA | Pantoea sp. | — | — | 1 | 1 | 1 | 2 | — | — | 1 | 1 |
| SYM00085 | 842 | Cuba | Pantoea sp. | — | — | 1 | 1 | 1 | 2 | — | 3 | 1 | 3 |
| SYM00086 | 843 | Peru | Pantoea sp. | — | — | 1 | 1 | 1 | — | Yes | — | 1 | 1 |
| SYM00088 | 844 | USA | Pantoea sp. | — | 1 | 1 | 1 | 1 | 2 | Yes | — | 1 | 1 |
| SYM00094 | 845 | USA | Pantoea sp. | — | — | 1 | 1 | 1 | 2 | — | — | — | — |
| SYM00095 | 846 | USA | Pantoea sp. | — | — | 1 | 1 | 1 | 1 | — | — | 3 | 1 |
| SYM00096 | 847 | USA | Pantoea sp. | 1 | — | 1 | 1 | 1 | 1 | — | — | 2 | 3 |
| SYM00100 | 848 | USA | Pantoea sp. | — | — | 1 | 1 | 1 | — | — | — | 3 | 3 |
| SYM00101 | 849 | USA | Pantoea sp. | — | 1 | 1 | 1 | 1 | 2 | — | — | 3 | 1 |
| SYM00502 | 850 | USA | Erwinia sp. | 1 | 1 | 1 | 1 | 1 | — | — | 1 | 2 | 3 |
| SYM00506 | 851 | USA | Erwinia sp. | — | 1 | 1 | 1 | 1 | 1 | — | 1 | 3 | 1 |
| SYM00506b | 852 | USA | Erwinia sp. | — | — | — | — | — | — | — | — | 3 | 3 |
| SYM00511 | 853 | Virgin Islands, USA | Erwinia sp. | — | 1 | 1 | 1 | 1 | 2 | — | — | 2 | 1 |
| SYM00514b | 854 | Virgin Islands, USA | Erwinia sp. | — | 1 | 1 | 1 | — | — | — | — | 3 | 3 |
| SYM00514C | 855 | Virgin Islands, USA | Erwinia sp. | — | 1 | 1 | 1 | — | — | — | — | — | — |
| SYM00514D | 856 | Virgin Islands, USA | Erwinia sp. | — | 1 | 1 | 1 | — | — | — | — | 2 | — |
| SYM00731A | 857 | Louisiana, USA | Erwinia sp. | — | 1 | 1 | 1 | — | 1 | — | — | 2 | — |
| SYM00785 | 858 | Thailand | Erwinia sp. | — | — | — | — | — | 2 | — | — | 2 | — |
| SYM00544 | 859 | Ecuador | Ochrobactrum sp. | — | — | — | — | — | 1 | — | — | 3 | — |
| SYM00545B | 860 | Ecuador | Ochrobactrum sp. | — | — | — | — | — | — | — | — | 2 | — |
| SYM00548 | 861 | Magdalena, Colombia | Ochrobactrum sp. | — | — | — | — | — | 1 | — | — | 2 | 1 |
| SYM00552 | 862 | Magdalena, Colombia | Ochrobactrum sp. | — | — | — | — | — | — | — | — | 2 | — |
| SYM00558 | 863 | Narino, Colombia | Ochrobactrum sp. | — | — | — | — | — | 1 | — | — | 2 | — |
| SYM00580b | 864 | Peru | Ochrobactrum sp. | — | — | — | — | — | — | — | — | 1 | — |
| SYM00580d | 865 | Peru | Ochrobactrum sp. | — | — | — | — | — | — | — | — | 2 | — |
| SYM00583 | 866 | Columbia | Ochrobactrum sp. | — | — | — | — | — | 1 | — | — | 2 | — |
| SYM00584 | 867 | Columbia | Ochrobactrum sp. | — | — | — | — | — | 1 | — | — | 2 | — |
| SYM00588 | 868 | Columbia | Ochrobactrum sp. | — | — | — | — | — | 1 | — | — | 2 | 2 |
| SYM00596 | 869 | Peru | Ochrobactrum sp. | — | — | — | — | — | 1 | — | — | 2 | 3 |
| SYM00600 | 870 | Peru | Ochrobactrum sp. | — | — | — | — | — | 2 | — | — | 2 | — |

TABLE I-continued

Functional assays to examine the potential for seed-origin microbes to confer novel functions to crops.

| Sym Strain ID | SEQ ID NO: | Habitat origin | Taxonomy | Antagonizes E. coli | Antagonizes S. cerevisiae | Shows Cellulolytic activity | Shows Pectinolytic activity | Secretes siderophores | Phosphate Solubilization | Growth on N Free LGI | ACC Deaminase Activity | Produces Auxin/Indoles | Produces Acetoin |
|---|---|---|---|---|---|---|---|---|---|---|---|---|---|
| SYM00746 | 871 | South Korea | Ochrobactrum sp. | 1 | 1 | — | — | — | 1 | — | 1 | 1 | 1 |
| SYM00752 | 872 | Mexico, Mexico | Ochrobactrum sp. | 1 | 1 | — | — | — | 1 | — | 1 | 2 | — |
| SYM00756 | 873 | Mexico, Mexico | Ochrobactrum sp. | 1 | — | — | — | — | 1 | — | 1 | — | — |
| SYM00763 | 874 | Mexico, Mexico | Ochrobactrum sp. | 1 | — | — | — | — | 1 | — | — | 2 | — |
| SYM00783 | 875 | Thailand | Ochrobactrum sp. | 1 | 1 | — | — | — | — | — | — | 2 | — |
| SYM00812 | 876 | Ashanti, Ghana | Ochrobactrum sp. | — | — | — | — | — | — | — | — | 2 | — |
| SYM00064a | 877 | Michoacan, Mexico | Stenotrophomonas sp. | — | — | — | — | — | — | — | — | 1 | 2 |
| SYM00183 | 878 | Amazonas, Brazil | Stenotrophomonas sp. | — | — | — | — | — | — | — | — | 1 | 2 |
| SYM00184 | 879 | Amazonas, Brazil | Stenotrophomonas sp. | — | — | — | — | — | — | — | — | 1 | 3 |
| SYM00543 | 880 | Ecuador | Bacillus sp. | 1 | 1 | — | — | — | 1 | — | — | 1 | — |
| SYM00595 | 881 | Peru | Bacillus sp. | 1 | — | — | — | — | 1 | — | — | 1 | — |
| SYM00580C | 882 | Peru | Achromobacter sp. | — | — | — | — | 1 | — | — | — | 1 | — |
| SYM00547 | 883 | Magdalena, Colombia | Achromobacter sp. | — | — | — | — | 2 | — | — | — | 1 | — |
| SYM00551 | 884 | Magdalena, Colombia | Achromobacter sp. | — | 1 | — | — | 1 | 2 | — | 2 | 2 | — |
| SYM00560 | 885 | Nariño, Colombia | Achromobacter sp. | — | — | — | — | 1 | — | — | — | 1 | — |
| SYM00565B | 886 | Mexico | Achromobacter sp. | — | — | — | — | — | 1 | — | 1 | 1 | 1 |
| SYM00580i | 887 | Peru | Achromobacter sp. | — | 1 | — | — | — | — | — | — | 1 | — |
| SYM00585 | 888 | Columbia | Achromobacter sp. | — | — | — | — | 1 | 2 | — | 1 | 2 | — |
| SYM00586b | 889 | Columbia | Achromobacter sp. | — | 1 | — | — | 2 | — | — | — | 2 | 2 |
| SYM00588b | 890 | Columbia | Achromobacter sp. | — | — | — | — | — | — | — | — | 3 | — |
| SYM00591 | 891 | Peru | Achromobacter sp. | — | — | — | — | 3 | — | — | 3 | 1 | 2 |
| SYM00602 | 892 | Ancash, Peru | Achromobacter sp. | — | — | 1 | 1 | — | 1 | — | 3 | 1 | — |
| SYM00758 | 893 | Mexico, Mexico | Achromobacter sp. | — | — | 1 | 1 | 1 | 1 | — | 3 | 1 | — |
| SYM00761 | 894 | Mexico, Mexico | Achromobacter sp. | — | — | 1 | 1 | 1 | — | — | 1 | — | — |
| SYM00764 | 895 | Mexico, Mexico | Achromobacter sp. | 1 | 2 | — | — | 1 | — | — | — | — | 3 |
| SYM00765 | 896 | Mexico, Mexico | Achromobacter sp. | — | — | — | — | 1 | — | — | 3 | 1 | — |
| SYM00824 | 897 | Kabul, Afghanistan | Achromobacter sp. | — | — | — | — | — | — | — | 3 | — | — |
| SYM00828 | 898 | Kabul, Afghanistan | Achromobacter sp. | — | — | — | — | 1 | — | — | 3 | 1 | — |
| SYM00830 | 899 | Kabul, Afghanistan | Achromobacter sp. | — | — | — | — | — | — | — | 3 | — | — |
| SYM00831 | 900 | Kabul, Afghanistan | Achromobacter sp. | — | — | — | — | 1 | 1 | — | 1 | 1 | 3 |
| SYM00028 | 901 | Arizona, U.S. | Enterobacter sp. | — | — | — | — | 1 | 1 | — | — | — | 1 |
| SYM00052 | 902 | Guerrero, Mexico | Enterobacter sp. | — | — | — | — | — | 2 | — | — | — | 3 |
| SYM00053 | 903 | Guerrero, Mexico | Enterobacter sp. | — | — | — | — | — | 2 | Yes | — | — | — |
| SYM00054 | 904 | Guerrero, Mexico | Enterobacter sp. | — | — | — | — | — | 2 | — | — | — | 3 |
| SYM00175 | 905 | Unknown | Enterobacter sp. | — | — | — | — | — | — | — | 1 | 1 | 3 |
| SYM00627 | 906 | Indiana, USA | Enterobacter sp. | 1 | 2 | — | — | — | — | — | 1 | — | 2 |
| SYM00715 | 907 | Guandong, China | Enterobacter sp. | — | — | — | — | — | 2 | — | — | — | 1 |
| SYM00189 | 908 | USA | Bacillus sp. | — | — | — | — | — | — | — | — | — | — |
| SYM00192 | 909 | USA | Bacillus sp. | — | — | — | — | — | — | — | — | — | — |
| SYM00197 | 910 | USA | Bacillus sp. | — | — | — | — | — | — | — | — | 1 | 2 |
| SYM00201 | 911 | USA | Bacillus sp. | — | — | — | — | — | 2 | — | — | — | — |
| SYM00202 | 912 | USA | Bacillus sp. | — | — | — | — | — | — | — | — | 1 | 3 |
| SYM00215 | 913 | Unknown | Bacillus sp. | — | — | — | — | — | — | — | — | — | — |
| SYM00233 | 914 | Unknown | Bacillus sp. | — | — | — | — | — | 1 | Yes | — | 2 | 1 |
| SYM00016b | 915 | Arkansas, USA | Methylobacterium sp. | — | — | — | — | — | 1 | — | 1 | 1 | 1 |
| SYM00236 | 916 | Louisiana, USA | Methylobacterium sp. | — | — | — | 1 | — | — | Yes | — | — | — |
| SYM00237 | 917 | Louisiana, USA | Methylobacterium sp. | — | — | — | 1 | — | — | Yes | 1 | 2 | — |

TABLE I-continued

Functional assays to examine the potential for seed-origin microbes to confer novel functions to crops.

| Sym Strain ID | SEQ ID NO: | Habitat origin | Taxonomy | Antagonizes E. coli | Antagonizes S. cereviscae | Shows Cellulolytic activity | Shows Pectinolytic activity | Secretes siderophores | Phosphate Solubilization | Growth on N Free LGI | ACC Deaminase Activity | Produces Auxin/ Indoles | Produces Acetoin |
|---|---|---|---|---|---|---|---|---|---|---|---|---|---|
| SYM00240 | 918 | Unknown | Methylobacterium sp. | — | — | — | — | — | 1 | Yes | 3 | — | — |
| SYM00501 | 919 | USA | Burkholderia sp. | 3 | 1 | — | — | 2 | — | — | 3 | 2 | — |
| SYM00504 | 920 | USA | Burkholderia sp. | 3 | 1 | — | — | 2 | 1 | — | 3 | 2 | — |
| SYM00536 | 921 | Oyo, Nigeria | Burkholderia sp. | 1 | 1 | — | — | 3 | — | — | 1 | 2 | — |
| SYM00538E | 922 | Oyo, Nigeria | Burkholderia sp. | 2 | 1 | — | — | 2 | — | — | 3 | 1 | — |
| SYM00566A | 923 | Mexico | Burkholderia sp. | 2 | 1 | — | — | 2 | — | — | 3 | 1 | 3 |
| SYM00568 | 924 | Mexico | Burkholderia sp. | 2 | 1 | — | — | 2 | 1 | — | 3 | 1 | — |
| SYM00570 | 925 | Haiti | Burkholderia sp. | 3 | 1 | — | — | 2 | 1 | — | 3 | 1 | 1 |
| SYM00574 | 926 | Haiti | Burkholderia sp. | 2 | 1 | — | — | 2 | 1 | — | 3 | 1 | — |
| SYM00575 | 927 | Peru | Burkholderia sp. | 2 | 1 | — | — | 2 | 2 | — | 3 | — | — |
| SYM00578 | 928 | Indiana, USA | Burkholderia sp. | 1 | 1 | — | — | 3 | — | — | 3 | 1 | — |
| SYM00621 | 929 | Indiana, USA | Burkholderia sp. | 1 | 1 | — | — | 3 | — | — | 3 | — | — |
| SYM00623 | 930 | Indiana, USA | Burkholderia sp. | 1 | 1 | — | — | 3 | — | — | 3 | — | — |
| SYM00624 | 931 | Peru | Burkholderia sp. | 1 | 1 | — | 1 | 2 | 2 | — | 1 | — | — |
| SYM00633 | 932 | Peru | Burkholderia sp. | 1 | — | 1 | — | 3 | 1 | — | — | 3 | 3 |
| SYM00822 | 933 | Ashanti, Ghana | Burkholderia sp. | — | — | — | — | 3 | — | — | — | — | — |
| SYM00037 | 934 | USA | Bacillus sp. | — | 2 | — | — | — | — | — | — | — | 2 |
| SYM00051 | 935 | Guererro, Mexico | Microbacterium sp. | 1 | — | — | — | 2 | — | Yes | — | 2 | 2 |
| SYM00104 | 936 | Peru | Microbacterium sp. | — | — | — | — | — | — | — | — | 1 | 3 |
| SYM00177 | 937 | India | Microbacterium sp. | — | — | — | — | — | — | — | — | 2 | 2 |
| SYM00514A | 938 | Virgin Islands, USA | Microbacterium sp. | — | — | 1 | 1 | — | — | — | — | 2 | 2 |
| SYM00523 | 939 | Rangoon, Myanmar | Microbacterium sp. | — | — | 1 | — | — | — | — | — | — | — |
| SYM00538H | 940 | Oyo, Nigeria | Microbacterium sp. | — | — | 1 | 1 | — | — | — | — | 3 | 3 |
| SYM00542 | 941 | Ecuador | Microbacterium sp. | — | — | — | — | — | — | — | — | 3 | 2 |
| SYM00556 | 942 | Magdalena, Colombia | Microbacterium sp. | — | — | 1 | 1 | — | — | — | — | 2 | 3 |
| SYM00581A | 943 | Peru | Microbacterium sp. | — | — | 2 | 2 | — | — | — | — | 2 | 2 |
| SYM00586c | 944 | Columbia | Microbacterium sp. | — | — | — | — | — | — | — | — | 1 | 1 |
| SYM00587 | 945 | Columbia | Microbacterium sp. | — | — | — | — | — | — | — | — | 2 | 3 |
| SYM00598 | 946 | Peru | Microbacterium sp. | — | — | — | — | — | — | — | — | 3 | 2 |
| SYM00757 | 947 | Mexico, Mexico | Microbacterium sp. | — | — | 2 | 2 | 1 | — | — | 1 | — | — |
| SYM00760 | 948 | Mexico, Mexico | Microbacterium sp. | — | — | 3 | 3 | — | — | — | 1 | — | — |
| SYM00780 | 949 | Kentucky, USA | Microbacterium sp. | — | — | 2 | 2 | 2 | — | — | — | 2 | 1 |
| SYM00832 | 950 | Kabul, Afghanistan | Microbacterium sp. | 1 | 1 | 1 | 1 | 2 | — | — | — | 2 | 1 |
| SYM00015 | 951 | Arkansas, USA | Xanthomonas sp. | 2 | 1 | — | — | — | 1 | Yes | — | 1 | 1 |
| SYM00021 | 952 | Guererro, Mexico | Xanthomonas sp. | 1 | — | — | — | 2 | — | — | 1 | 1 | 1 |
| SYM00179 | 953 | Guandong, China | Xanthomonas sp. | — | — | — | — | — | 1 | — | — | 2 | — |
| SYM00182 | 954 | Guandong, China | Xanthomonas sp. | — | — | — | — | 1 | — | — | 1 | 1 | 3 |
| SYM00252 | 955 | Guandong, China | Xanthomonas sp. | — | — | — | — | 2 | — | Yes | — | 3 | — |
| SYM00565A | 956 | Mexico | Rhodococcus sp. | — | — | — | — | — | 1 | — | — | — | — |
| SYM00580G | 957 | Peru | Rhodococcus sp. | 1 | 1 | — | — | — | — | Yes | 1 | 1 | 1 |
| SYM00753 | 958 | Mexico, Mexico | Rhodococcus sp. | 1 | — | — | — | 1 | 1 | Yes | 1 | 1 | 1 |
| SYM00762 | 959 | Mexico, Mexico | Rhodococcus sp. | 1 | 1 | — | — | 2 | 1 | Yes | 1 | 1 | 2 |
| SYM00775 | 960 | Kentucky, USA | Paenibacillus sp. | — | — | — | — | — | — | — | 3 | 3 | — |
| SYM00589 | 961 | Columbia | Burkholderia phytofirmans | — | — | 1 | 1 | — | 1 | Yes | — | 1 | 2 |
| SYM00057B | 962 | USA | | — | — | — | — | — | — | — | — | — | — |
| SYM00102 | 963 | Colombia | Staphylococcus sp. | — | — | — | — | — | — | — | — | — | 2 |

TABLE I-continued

Functional assays to examine the potential for seed-origin microbes to confer novel functions to crops.

| Sym Strain ID | SEQ ID NO: | Habitat origin | Taxonomy | Antagonizes E. coli | Antagonizes S. cereviscae | Shows Cellulolytic activity | Shows Pectinolytic activity | Secretes siderophores | Phosphate Solubilization | Growth on N Free LGI | ACC Deaminase Activity | Produces Auxin/Indoles | Produces Acetoin |
|---|---|---|---|---|---|---|---|---|---|---|---|---|---|
| SYM00072 | 964 | Durango, Mexico | Bacillus sp. | 2 | — | — | — | — | — | — | — | — | 3 |
| SYM00075 | 965 | Durango, Mexico | Bacillus sp. | 2 | — | — | — | — | — | — | — | — | 3 |
| SYM00249 | 966 | Guangxi, China | Bacillus sp. | — | 1 | — | — | — | — | — | — | — | 1 |
| SYM00507 | 967 | USA | Bacillus sp. | 2 | 1 | — | — | — | — | — | — | 2 | 1 |
| SYM00553 | 968 | Magdalena, Colombia | Bacillus sp. | 2 | 1 | — | — | — | — | — | — | — | — |
| SYM00562 | 969 | Narino, Colombia | Bacillus sp. | 2 | 1 | — | — | — | — | — | — | — | 1 |
| SYM00564 | 970 | Narino, Colombia | Bacillus sp. | 2 | 1 | — | — | 1 | — | — | — | 2 | 3 |
| SYM00580E | 971 | Peru | Bacillus sp. | — | 1 | — | — | — | — | — | — | 1 | 3 |
| SYM00581b | 972 | Peru | Bacillus sp. | 2 | 1 | — | — | — | — | — | 1 | — | 3 |
| SYM00581c | 973 | Peru | Bacillus sp. | — | — | — | — | — | — | — | — | — | 3 |
| SYM00601 | 974 | Peru | Bacillus sp. | 1 | — | — | — | — | — | — | — | — | 3 |
| SYM00036 | 975 | Cuba | Bacillus sp. | 3 | 2 | — | — | — | — | Yes | — | 1 | — |
| SYM00110 | 976 | USA | Bacillus sp. | 3 | 1 | — | — | — | — | — | — | — | 1 |
| SYM00193 | 977 | USA | Bacillus sp. | 3 | — | — | — | — | — | — | — | — | — |
| SYM00218 | 978 | Unknown | Bacillus sp. | 3 | 1 | — | — | — | — | Yes | — | — | 3 |
| SYM00250 | 979 | Guangxi, China | Bacillus sp. | — | 3 | — | — | — | — | — | — | — | 3 |
| SYM00697 | 980 | Northern Cameroon | Bacillus sp. | 3 | 3 | — | — | — | — | — | — | — | 3 |
| SYM00704 | 981 | Northern Cameroon | Bacillus sp. | 3 | — | — | — | — | — | Yes | — | 2 | 1 |
| SYM00017c | 982 | Arkansas, USA | Sphingomonas sp. | — | — | 1 | 1 | — | — | — | — | 3 | 1 |
| SYM00062b | 983 | Michoacan, Mexico | Sphingomonas sp. | — | — | 1 | 1 | — | 1 | — | — | 2 | 1 |
| SYM00065 | 984 | Michoacan, Mexico | Sphingomonas sp. | — | — | 2 | 2 | — | 2 | Yes | — | 3 | 1 |
| SYM00168 | 985 | Unknown | Sphingomonas sp. | — | 1 | 2 | 2 | — | 2 | Yes | — | 3 | 2 |
| SYM00169 | 986 | Unknown | Sphingomonas sp. | — | 1 | 2 | 2 | 1 | 2 | Yes | — | 2 | 3 |
| SYM00231 | 987 | Unknown | Sphingobium sp. | — | 1 | — | — | 2 | — | — | — | 3 | 1 |
| SYM00975 | 988 | South Korea | Herbaspirillum sp. | — | — | — | — | — | — | — | — | — | — |
| SYM00506c | 989 | USA | Paenibacillus sp. | — | 1 | 1 | 1 | 2 | 1 | — | — | 2 | — |
| SYM00506D | 990 | USA | Paenibacillus sp. | — | — | 1 | 1 | — | 1 | — | — | 1 | 1 |
| SYM00545 | 991 | Ecuador | Paenibacillus sp. | — | — | 1 | 1 | — | 1 | — | — | 1 | 1 |
| SYM00549 | 992 | Magdalena, Colombia | Paenibacillus sp. | — | — | — | — | — | — | — | 1 | 3 | — |
| SYM00554 | 993 | Magdalena, Colombia | Paenibacillus sp. | — | 1 | 1 | 1 | — | — | — | — | — | 1 |
| SYM00555 | 994 | Magdalena, Colombia | Paenibacillus sp. | 1 | — | — | — | 1 | — | — | — | 1 | 1 |
| SYM00012 | 995 | Durango, Mexico | Microbacterium binotii | — | — | — | — | — | — | — | — | — | — |
| SYM00046 | 996 | USA | Enterobacter sp. | 1 | 3 | 1 | 1 | 2 | 1 | Yes | — | 1 | 3 |
| SYM00050 | 997 | USA | Enterobacter sp. | — | 2 | 1 | 1 | 1 | 1 | Yes | — | 2 | 2 |
| SYM00628 | 998 | Indiana, USA | Enterobacter sp. | 1 | 1 | 1 | 1 | — | — | Yes | — | 3 | 3 |
| SYM00106 | 999 | Peru | Micrococcus sp. | — | — | — | — | — | — | — | — | — | — |
| SYM00107 | 1000 | Peru | Micrococcus sp. | — | — | — | — | — | — | — | — | — | 1 |
| SYM00108 | 1001 | Peru | Micrococcus sp. | 1 | 1 | 1 | 1 | — | — | — | — | 1 | — |
| SYM00090 | 1002 | USA | Chryseobacterium sp. | — | — | — | — | — | — | — | — | — | — |
| SYM00002 | 1003 | Durango, Mexico | Agrobacterium sp. | — | — | 2 | 2 | — | — | — | — | 3 | 3 |
| SYM00017a | 1004 | Arkansas, USA | Agrobacterium sp. | — | — | 2 | 2 | — | — | — | — | 3 | 2 |
| SYM00714 | 1005 | Guandong, China | Agrobacterium sp. | — | — | 2 | 1 | — | — | — | 1 | 2 | 3 |
| SYM00060 | 1006 | Peru | Staphylococcus sp. | — | — | — | — | — | — | — | — | — | 1 |
| SYM00071 | 1007 | Durango, Mexico | Bacillus sp. | — | — | — | — | — | — | — | — | 3 | 3 |
| SYM00204 | 1008 | USA | Bacillus sp. | — | — | — | — | — | — | — | — | 3 | 2 |
| SYM00563 | 1009 | Narino, Colombia | Bacillus sp. | — | — | — | — | — | — | — | — | — | — |

TABLE I-continued

Functional assays to examine the potential for seed-origin microbes to confer novel functions to crops.

| Sym Strain ID | SEQ ID NO: | Habitat origin | Taxonomy | Antagonizes E. coli | Antagonizes S. cereviscae | Shows Cellulolytic activity | Shows Pectinolytic activity | Secretes siderophores | Phosphate Solubilization | Growth on N Free LGI | ACC Deaminase Activity | Produces Auxin/ Indoles | Produces Acetoin |
|---|---|---|---|---|---|---|---|---|---|---|---|---|---|
| SYM00617 | 1010 | Ancash, Peru | Bacillus sp. | — | — | — | — | — | — | — | — | 1 | 2 |
| SYM00960 | 1011 | Louisiana, USA | Luteibacter sp. | — | — | — | — | 2 | — | — | — | — | 3 |
| SYM00940 | 1012 | Zhejian, China | | — | — | — | — | 1 | 1 | — | — | — | 3 |
| SYM00713 | 1013 | Guandong, China | Erwinia sp. | — | 1 | 1 | 1 | — | 1 | — | 1 | 2 | 1 |
| SYM00992 | 1014 | Mindanao, Phillipines | Sphingomonas sp. | 1 | — | — | — | — | 2 | — | — | 1 | 3 |
| SYM00063 | 1015 | Michoacan, Mexico | Microbacterium sp. | — | — | — | — | — | — | — | — | 1 | — |
| SYM00226 | 1016 | Unknown | Microbacterium sp. | — | 1 | — | — | — | — | — | — | 1 | 1 |
| SYM00246 | 1017 | Unknown | Microbacterium sp. | — | — | — | — | — | — | — | — | 1 | — |
| SYM00524 | 1018 | Rangoon, Myanmar | Microbacterium sp. | — | — | — | — | — | — | — | — | 1 | 3 |
| SYM00199 | 1019 | USA | Bacillus sp. | — | — | — | — | — | 2 | — | — | — | — |
| SYM00172 | 1020 | Louisiana, USA | Pantoea sp. | 2 | — | 1 | 1 | 3 | 2 | Yes | — | 3 | 3 |
| SYM00527 | 1021 | Rangoon, Myanmar | Erwinia sp. | — | — | 1 | 1 | 1 | 1 | — | 3 | 3 | 1 |
| SYM00644 | 1022 | Segou, Mali | Erwinia sp. | — | — | 1 | 1 | 1 | 2 | — | 1 | 2 | 2 |
| SYM00648 | 1023 | Segou, Mali | | 1 | 1 | 1 | — | 1 | — | — | — | 1 | 3 |
| SYM00538A | 1024 | Oyo, Nigeria | Sphingomonas sp. | — | — | 1 | 1 | — | 1 | — | — | 2 | — |
| SYM00508 | 1025 | USA | | — | — | 1 | 1 | — | — | — | — | 2 | — |

Legend:
"—" indicates no significant increase;
"1" = low activity;
"2" = medium activity;
"3" = high activity Production of Auxin (SD)

To allow isolates to grow and accumulate auxin, bacterial strains were inoculated into 250 μL of R2A broth supplemented with L-tryptophan (5 mM) in 350 μL deep, transparent flat bottom, 96 well culture plates. The plates were sealed with a breathable membrane and incubated at 28 C under static conditions for 3 days. After 3 days the OD600 and OD530 nm were measured on a plate reader to check for bacterial growth. After measuring these ODs, 50 μL of yellowish Salkowski reagent (0.01 M FeCl3 μl 35% HClO4 (perchloric acid, #311421, Sigma) were added to each well and incubated in the dark for 30 minutes before measuring the OD530 nm measured to detect pink/red color. As mentioned in Example 5, auxin is an important plant hormone. Seed-origin bacteria were screened for their ability to produce auxins as possible root growth promoting agents. A very large number of bacteria showed a detectable level of pink or red colour development (the diagnostic feature of the assay suggesting auxin or indolic compound production)— 169 out of 247. 89 strains had particularly strong production of auxin or indole compounds. *Erwinia* and *Pantoea* species are very similar if not identical taxonomic groups and can thus be considered together—of a total of 38 isolates, 23 had moderate or strong production of auxin or indole compounds in vitro. Many of these *Erwinia* and *Pantoea* strains were isolated from inside surface sterilized seeds, suggesting they may be able to colonize the inside of the emerging root (first plant part to emerge the seed) and stimulate root growth for by producing auxins on the inside of the plant.

Another important group of auxin producing seed-origin bacteria were *Pseudomonas* species, 9 of the 14 isolated showed significant production of indoles in this assay. *Ochrobactrum* species were also detected as strong producers of indolic compounds in this assay, with 15 of 18 showing moderate to strong color change (although all 18 had detectable colour change in this assay). Strongly auxin producing strains of *Pseudomonas* and *Ochrobactrum* species were isolated from seed surfaces.

Mineral Phosphate Solubilization

Microbes were plated on tricalcium phosphate media as described in Rodriguez et al., (2001) J Biotechnol 84: 155-161 (incorporated herein by reference). This was prepared as follows: 10 g/L glucose, 0.373 g/L NH$_4$NO$_3$, 0.41 g/L MgSO$_4$, 0.295 g/L NaCl, 0.003 FeCl$_3$, 0.7 g/L Ca$_3$HPO$_4$, 100 mM Tris and 20 g/L Agar, pH 7, then autoclaved and poured into square Petri plates. After 3 days of growth at 28° C. in darkness, clear halos were measured around colonies able to solubilize the tricalcium phosphate. This was an agar based assay looking for halos around colonies which signify the solubilization of opaque tri-calcium phosphate, which resulted in a large number (95) of isolates having detectable levels of phosphate solubilization (Table I). Of these, at least 36 had moderate to high levels of phosphate solubilization, including several *Enterobacter* and *Pantoea* species.

Growth on Nitrogen Free LGI Media

All glassware was cleaned with 6 M HCl before media preparation. A new 96 well plate (300 ul well volume) was filled with 250 ul/well of sterile LGI broth [per L, 50 g Sucrose, 0.01 g FeCl$_3$-6H$_2$O, 0.8 g K$_3$PO$_4$, 0.2 g CaCl2, 0.2 g MgSO$_4$-7H$_2$O, 0.002 g Na$_2$MoO$_4$-2H$_2$O, pH 7.5]. Bacteria were inoculated into the 96 wells simultaneously with a flame-sterilized 96 pin replicator. The plate was sealed with a breathable membrane, incubated at 28° C. without shaking for 5 days, and OD$_{600}$ readings taken with a 96 well plate reader.

A nitrogen fixing plant associated bacterium is able theoretically to add to the host's nitrogen metabolism, and the most famous beneficial plant associated bacteria, *rhizobia*, are able to do this within specially adapted organs on the roots of leguminous plants. The seed associated bacteria in this study may be able to fix nitrogen in association with the developing seedling, whether they colonize the plant's surfaces or interior and thereby add to the plant's nitrogen nutrition.

In total, of the 247 isolates there were 34 (14%) that had detectable growth under nitrogen limiting conditions (Table J)

TABLE J

Endophytes capable of growing on N free media

| Genus | Seed-origin isolates growing on N Free Media |
|---|---|
| *Bacillus* sp. | 3 |
| *Burkholderia* sp. | 1 |
| *Curtobacterium* sp. | 1 |
| *Enterobacter* sp. | 1 |
| *Methylobacterium* sp. | 3 |
| *Microbacterium* sp. | 1 |
| *Micrococcus* sp. | 3 |
| *Pantoea* sp. | 9 |
| *Pseudomonas* sp. | 3 |
| *Rhodococcus* sp. | 3 |
| *Sphingobium* sp. | 1 |
| *Sphingomonas* sp. | 3 |
| *Xanthomonas* sp. | 2 |

ACC Deaminase Activity

Microbes were assayed for growth with ACC as their sole source of nitrogen. Prior to media preparation all glassware was cleaned with 6 M HCl. A 2 M filter sterilized solution of ACC (#1373A, Research Organics, USA) was prepared in water. 2 μl/mL of this was added to autoclaved LGI broth (see above), and 250 μL aliquots were placed in a brand new (clean) 96 well plate. The plate was inoculated with a 96 pin library replicator, sealed with a breathable membrane, incubated at 28° C. without shaking for 5 days, and OD600 readings taken. Only wells that were significantly more turbid than their corresponding nitrogen free LGI wells were considered to display ACC deaminase activity.

As described in Example 5, plant stress reactions are strongly impacted by the plant's own production and overproduction of the gaseous hormone ethylene, the precursor of which can be diverted from ethylene metabolism by microbial and plant enzymes having ACC deaminase activity. In total, of the 247 isolates there were 68 (28%) which had greater growth on nitrogen free LGI media supplemented with ACC, than in nitrogen free LGI. Of these, only 11% had very high ACC deaminase activity and these were mostly strains of *Achromobacter*, *Burkholderia*, and *Pseudomonas*. Chief amongst these were *Burkholderia* species which held ACC deaminase as their most distinctive in vitro characteristic—94% or 15 out of 16 *Burkholderia* isolates had ACC deaminase activity. Of *Burkholderia* isolates, 81% had strong ACC deaminase activity, while only 42% of *Achromobacter* species (5 of 12 isolates) had strong ACC deaminase activity, and next were *Pseudomonas* where only 5 of 14 isolates (42%) had strong activity. Many *Curtobacteria* isolates appeared to have ACC deaminase activity as well, however these were all rated low (as 1) and thus of less interest than the preceeding groups of isolates.

TABLE K

Endophytes capable of growing on ACC as the sole nitrogen source.

| Genus | Seed-Origin Isolates growing on ACC as the sole Nitrogen Source |
|---|---|
| *Achromobacter* sp. | 12 |
| *Agrobacterium* sp. | 1 |
| *Bacillus* sp. | 1 |
| *Burkholderia* sp. | 15 |
| *Curtobacterium* sp. | 9 |
| *Enterobacter* sp. | 3 |
| *Erwinia* sp. | 5 |
| *Methylobacterium* sp. | 3 |
| *Microbacterium* sp. | 2 |
| *Ochrobactrum* sp. | 3 |
| *Pantoea* sp. | 1 |
| *Pseudomonas* sp. | 7 |
| *Rhodococcus* sp. | 2 |
| *Xanthomonas* sp. | 1 |

Acetoin and Diacetyl Production

The method was adapted from Phalip et al., (1994) J Basic Microbiol 34: 277-280. (incorporated herein by reference). 250 ml of autoclaved R2A broth supplemented with 0.5% glucose was aliquoted into a 96 well plate (#07-200-700, Fisher). The bacterial endophytes from a glycerol stock plate were inoculated into the plate using a flame-sterilized 96 pin replicator, sealed with a breathable membrane, then incubated for 3 days without shaking at 28° C. At day 5, 50 µl/well was added of freshly blended Barritt's Reagents A and B [5 g/L creatine mixed 3:1 (v/v) with freshly prepared $\alpha$-naphthol (75 g/L in 2.5 M sodium hydroxide)]. After 15 minutes, plates were scored for red or pink coloration relative to a copper colored negative control (measured as 525 nm absorption on a plate reader).

A large number of seed-origin bacteria showed a detectable level of pink or red color development (126 out of 247; See Table I). 70 of 247 isolates had strong production of acetoin or butanediol as detected by this assay. *Bacillus* (13 of 33), *Enterobacter* (8 or 16) and *Microbacterium* (12 of 21) species were the most intense producers of acetoin/butanediol in this collection. In addition, two of the three isolates of *Stenotrophomonas* included in this study were also strong acetoin/butanediol producers.

Siderophore Production

To ensure no contaminating iron was carried over from previous experiments, all glassware was deferrated with 6 M HCl and water prior to media preparation [Cox (1994) Methods Enzymol 235: 315-329, incorporated herein by reference]. In this cleaned glassware, R2A broth media, which is iron limited, was prepared and poured (250 ul/well) into 96 well plates and the plate then inoculated with bacteria using a 96 pin plate replicator. After 3 days of incubation at 28° C. without shaking, to each well was added 100 ul of O-CAS preparation without gelling agent [Perez-Miranda et al. (2007), J Microbiol Methods 70: 127-131, incorporated herein by reference]. One liter of O-CAS reagent was prepared using the cleaned glassware by mixing 60.5 mg of chrome azurol S (CAS), 72.9 mg of hexadecyl-trimethyl ammonium bromide (HDTMA), 30.24 g of finely crushed Piperazine-1,4-bis-2-ethanesulfonic acid (PIPES) with 10 ml of 1 mM $FeCl_3.6H_2O$ in 10 mM HCl solvent. The PIPES had to be finely powdered and mixed gently with stirring (not shaking) to avoid producing bubbles, until a deep blue color was achieved. 15 minutes after adding the reagent to each well, color change was scored by looking for purple halos (catechol type siderophores) or orange colonies (hydroxamate siderophores) relative to the deep blue of the O-CAS.

Siderophore production by bacteria on a plant surface or inside a plant may both show that a microbe is equipped to grow in a nutrient limited environment, and perhaps protect the plant environment from invasion by other, perhaps undesirable microbes. We searched for two types of siderophore which result in purple color change (catechol type siderophores) or orange color change (hydroxamate siderophores) after addition of the blue O-Cas reagent to 96 well plates. A large number of bacteria showed a detectable level of color change relative to the deep blue of the O-CAS; 80 out of 247. Notably, 32 of 247 strains had strong production of siderophores. Interestingly, strong siderophore producers included a large number (14) of the 16 *Burkholderia* isolates. Many isolates of *Achromobacter* (9 of 12) and *Pantoea* (15 of 26) were able to induce weak colour change in the O-CAS material (see Table L).

TABLE L

Endophytes producing Strong Siderophores

| Genus | Isolates Producing Strong Siderophores |
|---|---|
| *Achromobacter* sp. | 3 |
| *Burkholderia* sp. | 14 |
| *Curtobacterium* sp. | 2 |
| *Enterobacter* sp. | 1 |
| *Microbacterium* sp. | 1 |
| *Pantoea* sp. | 2 |
| *Pseudomonas* sp. | 5 |
| *Rhodococcus* sp. | 2 |
| *Xanthomonas* sp. | 2 |

Pectinase Activity

Iodine reacts with pectin to form a dark blue-colored complex, leaving clear halos as evidence of extracellular enzyme activity. Adapting a previous protocol [Soares et al. (1999) Rev de Microbiol 30: 299-303, incorporated herein by reference] 0.2% (w/v) of citrus pectin (#76280, Sigma) and 0.1% Triton X-100 were added to R2A media, autoclaved and poured into 150 mm plates. Bacteria were inoculated using a 96 pin plate replicator. After 3 days of culturing in the darkness at 25 C, pectinase activity was visualized by flooding the plate with Gram's iodine. Positive colonies were surrounded by clear halos. In our study, a large number, roughly 83 of the 247 isolates, had detectable pectinase activity, and 21 of these isolates had moderate to strong results visualized as medium to large halos—caused by copious diffusion of enzyme away from the bacteria.

Cellulase Activity

Iodine reacts with cellulose to form a dark brown/blue-colored complex, leaving clear halos as evidence of extracellular enzyme activity. Adapting a previous protocol [Kasana et al. (2008), Curr Microbiol 57: 503-507, incorporated herein by reference] 0.2% carboxymethylcellulose (CMC) sodium salt (#C5678, Sigma) and 0.1% triton X-100 were added to a starch free variant of R2A media, autoclaved and poured into 150 mm plates. Bacteria were inoculated using a 96 pin plate replicator. After 3 days of culturing in the darkness at 25 C, cellulose activity was visualized by flooding the plate with Gram's iodine. Positive colonies were surrounded by clear halos.

In our study, a large number, roughly 83 of the 247 isolates, had detectable cellulose activity, and 21 of these isolates had moderate to strong results visualized as medium to large halos—caused by copious diffusion of enzyme away from the bacteria.

Antibiosis

Briefly, colonies of either *E. coli* DH5α (bacterial tester) or yeast strain *Saccharomyces cerevisiae* AH109 (fungal tester) were resuspended in 1 mL R2A broth to an OD600 of 0.2, and 40 µL of this was mixed with 40 mL of warm R2A agar for pouring a single rectangular Petri dish. Seed derived bacteria were inoculated onto plates using a flame sterilized 96 pin plate replicator, incubated for 3 days at 28 C. Antibiosis was scored by observing clear halos around endophyte colonies.

A total of 59 and 72 isolates showed antibiosis activity against either *E. coli* or yeast, respectively (Table I). Antibiotic production by bacteria on a plant surface or inside a plant may both show that a microbe is ecologically aggressive (a survivor) and it may mean that it can help protect a plant against pathogens. Interestingly, three groups of bacteria, the Bacilli, Enterobacters and *Burkholderia* both had a large proportion of isolates (up to 45%, 50% and 88% respectively) which were inhibiting growth of *E. coli* and yeast, suggestive of a common mechanism of antiobiosis such as production and secretion of a broad spectrum antibiotic. As antibiosis effects were detected in the same 14 strains of *Burkholderia* that produced siderophores, *Burkholderia* mediated antibiosis may have been be caused by localized iron starvation, inhibiting both yeast and *E. coli* growth. A large number of Ochrobacterum isolates also had antagonism towards yeast growth.

Example 7: Identification of Additional Endophytes that can be Used to Produce Endoseed—Seeds Containing Endophytic Bacteria In order to identify additional endophytes that may be used to produce endoseeds, endophytic microbes that are present in multiple types of plants were identified.

Experimental Description

To identify core (i.e. ubiquitous) microbial taxa across seeds, high-throughput sequencing of marker genes for bacteria, archaea, and fungi was used. 50 commercial, 22 wild, and 33 landrace corn seeds, 40 commercial, 13 wild, and 23 landrace wheat seeds, 13 cotton seeds, and 24 soybean seeds were obtained. Non-commercial varieties were obtained from USDA GRIN through their National Plant Germplasm system (at the world wide web at ars/grin/gov/npgs/). Accessions were categorized into landrace, wild, and inbred varieties based on an assessment of their improvement status. In order to extract microbial DNA, the seeds were first soaked in sterile, DNA-free water for 48 h to soften them, and they were surface sterilized using 95% ethanol to reduce superficial contaminant microbes. The seeds were then ground using a mortar and pestle treated with 95% ethanol and RNAse Away (Life Technologies, Inc., Grand Island, N.Y.) to remove contaminant DNA. DNA was extracted from the ground seeds using the PowerPlant Pro DNA extraction kit (Mo Bio Laboratories, Inc., Carlsbad, Calif.) according to the manufacturer's instructions.

Marker genes were amplified and sequenced from the extracted DNA using a high-throughput protocol similar to (Fierer et al. 2012, McGuire et al. 2013). For the bacterial and archaeal analyses, the V4 hypervariable region of the 16S rRNA gene was targeted (primers 515f/806r), and for fungi, the first internal transcribed spacer (ITS1) region of the rRNA operon (primers ITS1f/ITS2r) was targeted. The two marker genes were PCR amplified separately using 35 cycles, and error-correcting 12-bp barcoded primers specific to each sample were used to facilitate combining of samples. To reduce the amplification of chloroplast and mitochondrial DNA, we used PNA clamps specific to the rRNA genes in these organelles (Lundberg et al. 2013). PCR reactions to amplify 16S rRNA genes followed the protocol of (Lundberg et al. 2013), and those to amplify ITS regions followed the protocol of (Fierer et al. 2012). PCR products were quantified using the PicoGreen assay (Life Technologies, Inc., Grand Island, N.Y.), pooled in equimolar concentrations, and cleaned using the UltraClean kit (Mo Bio Laboratories, Inc., Carlsbad, Calif.). Cleaned DNA pools were sequenced on an Illumina MiSeq instrument at the University of Colorado Next Generation Sequencing Facility.

The raw sequence data were reassigned to distinct samples using a custom Python script, and quality filtering and OTU (operational taxonomic unit) clustering was conducted using the UPARSE pipeline (Edgar 2013). Briefly, a de novo sequence database with representative sequences for each OTU was created using a 97% similarity threshold, and raw reads were mapped to this database to calculate sequence counts per OTU per sample. Prior to creating the database, sequences were quality filtered using an expected error frequency threshold of 0.5 errors per sequence. In addition, sequences were dereplicated and singletons were removed prior to creating the database. OTUs were provided taxonomic classifications using the RDP classifier (Wang et al. 2007) trained with the Greengenes (McDonald et al. 2012) or UNITE (Abarenkov et al. 2010) databases for 16S rRNA and ITS sequences, respectively. To account for differences in the number of sequences per sample, each sample was rarefied to 1,000 and 6,500 sequences per sample for 16S rRNA and ITS datasets. This resulted in samples with fewer sequences than the rarefaction depth to be discarded from downstream analyses. OTUs classified as chloroplasts or mitochondria were discarded prior to rarefaction.

OTUs were determined to be core taxa based on detection across a variety of seed types. For example, taxa core across crops were those detected in >5% of seeds from each of the crops that were assessed. Similarly, taxa core to an individual crop were those detected in >5% of seeds from each of the cultivar categories (i.e. wild, landrace, inbred, or modern) within that crop. As additional quality control measures, OTUs where at least class level taxonomy could not be resolved and OTUs characteristic of soil or human skin (Dunn et al. 2013) were discarded. OTU counts from replicate samples of identical seed types were averaged prior to analysis.

Results Example 7

The endophytic microbes that are present in multiple types of plants (core taxa) that may be used to produce endoseed are listed in Table M.

TABLE M

Core endophytes, including their 16S rRNA sequences, assignment
within OTU numbers, family, genus, and species information

| SEQ ID NO. | OTU | Family | Genus | Species |
|---|---|---|---|---|
| 1026 | OTU_2152 | Actinosynnemataceae | *Lentzea* | |
| 1027 | OTU_90 | Actinosynnemataceae | | |
| 1028 | OTU_309 | Dermabacteraceae | *Brachybacterium* | |
| 1029 | OTU_2984 | Geodermatophilaceae | | |
| 1030 | OTU_132 | Glycomycetaceae | *Glycomyces* | |
| 1031 | OTU_1588 | Intrasporangiaceae | *Phycicoccus* | |
| 1032 | OTU_161 | Kineosporiaceae | | |
| 1033 | OTU_1207 | Kineosporiaceae | | |
| 1034 | OTU_28 | Microbacteriaceae | | |
| 1035 | OTU_302 | Microbacteriaceae | | |
| 1036 | OTU_3428 | Microbacteriaceae | | |
| 1037 | OTU_94 | Micrococcaceae | *Arthrobacter* | *psychrolactophilus* |
| 1038 | OTU_2968 | Micrococcaceae | *Micrococcus* | |
| 1039 | OTU_179 | Micrococcaceae | | |
| 1040 | OTU_200 | Micromonosporaceae | | |
| 1041 | OTU_350 | Mycobacteriaceae | *Mycobacterium* | |
| 1042 | OTU_100 | Nocardioidaceae | *Aeromicrobium* | |
| 1043 | OTU_3177 | Nocardioidaceae | *Aeromicrobium* | |
| 1044 | OTU_1142 | Nocardioidaceae | *Kribbella* | |
| 1045 | OTU_238 | Nocardioidaceae | *Kribbella* | |
| 1046 | OTU_730 | Nocardioidaceae | | |
| 1047 | OTU_992 | Nocardioidaceae | | |
| 1048 | OTU_392 | Promicromonosporaceae | *Cellulosimicrobium* | |
| 1049 | OTU_91 | Promicromonosporaceae | *Promicromonospora* | |
| 1050 | OTU_134 | Pseudonocardiaceae | *Pseudonocardia* | |
| 1051 | OTU_573 | Streptomycetaceae | *Streptomyces* | *mirabilis* |
| 1052 | OTU_3556 | Streptomycetaceae | *Streptomyces* | |
| 1053 | OTU_88 | Streptomycetaceae | | |
| 1054 | OTU_409 | Streptomycetaceae | | |
| 1055 | OTU_882 | | | |
| 1056 | OTU_713 | Gaiellaceae | | |
| 1057 | OTU_402 | Chitinophagaceae | *Chitinophaga* | |
| 1058 | OTU_3325 | Chitinophagaceae | *Chitinophaga* | |
| 1059 | OTU_218 | Chitinophagaceae | *Lacibacter* | *cauensis* |
| 1060 | OTU_57 | Chitinophagaceae | *Sediminibacterium* | |
| 1061 | OTU_213 | Chitinophagaceae | | |
| 1062 | OTU_362 | Chitinophagaceae | | |
| 1063 | OTU_348 | Chitinophagaceae | | |
| 1064 | OTU_208 | Chitinophagaceae | | |
| 1065 | OTU_237 | Chitinophagaceae | | |
| 1066 | OTU_163 | Cyclobacteriaceae | *Algoriphagus* | *terrigena* |
| 1067 | OTU_112 | Cytophagaceae | *Dyadobacter* | |
| 1068 | OTU_120 | Cytophagaceae | *Dyadobacter* | |
| 1069 | OTU_234 | Cytophagaceae | *Emticicia* | |
| 1070 | OTU_210 | Cytophagaceae | | |
| 1071 | OTU_187 | Cytophagaceae | | |
| 1072 | OTU_152 | Cytophagaceae | | |
| 1073 | OTU_1201 | Cytophagaceae | | |
| 1074 | OTU_287 | Cytophagaceae | | |
| 1075 | OTU_377 | Cytophagaceae | | |
| 1076 | OTU_2342 | Cytophagaceae | | |
| 1077 | OTU_487 | | | |
| 1078 | OTU_276 | Cryomorphaceae | *Fluviicola* | |
| 1079 | OTU_141 | Flavobacteriaceae | *Flavobacterium* | *columnare* |
| 1080 | OTU_148 | Flavobacteriaceae | *Flavobacterium* | *succinicans* |
| 1081 | OTU_3571 | Flavobacteriaceae | *Flavobacterium* | *succinicans* |
| 1082 | OTU_3528 | Flavobacteriaceae | *Flavobacterium* | |
| 1083 | OTU_67 | Sphingobacteriaceae | *Pedobacter* | |
| 1084 | OTU_109 | Sphingobacteriaceae | *Pedobacter* | |
| 1085 | OTU_3687 | Sphingobacteriaceae | | |
| 1086 | OTU_3184 | Sphingobacteriaceae | | |
| 1087 | OTU_3212 | Sphingobacteriaceae | | |
| 1088 | OTU_3301 | Sphingobacteriaceae | | |
| 1089 | OTU_86 | Sphingobacteriaceae | | |
| 1090 | OTU_406 | Sphingobacteriaceae | | |
| 1091 | OTU_129 | Sphingobacteriaceae | | |
| 1092 | OTU_2892 | Sphingobacteriaceae | | |
| 1093 | OTU_3722 | Sphingobacteriaceae | | |
| 1094 | OTU_191 | | | |
| 1095 | OTU_223 | Parachlamydiaceae | *Candidatus* | *Protochlamydia* |
| 1096 | OTU_195 | | | |
| 1097 | OTU_790 | A4b | | |
| 1098 | OTU_103 | | | |
| 1099 | OTU_467 | Bacillaceae | *Bacillus* | *coagulans* |

TABLE M-continued

Core endophytes, including their 16S rRNA sequences, assignment within OTU numbers, family, genus, and species information

| SEQ ID NO. | OTU | Family | Genus | Species |
|---|---|---|---|---|
| 1100 | OTU_3 | Bacillaceae | Bacillus | firmus |
| 1101 | OTU_27 | Bacillaceae | Bacillus | flexus |
| 1102 | OTU_3473 | Bacillaceae | Bacillus | |
| 1103 | OTU_131 | Bacillaceae | Bacillus | |
| 1104 | OTU_106 | Bacillaceae | Geobacillus | |
| 1105 | OTU_6 | Paenibacillaceae | Paenibacillus | |
| 1106 | OTU_38 | Planococcaceae | | |
| 1107 | OTU_763 | | | |
| 1108 | OTU_9 | Clostridiaceae | Clostridium | butyricum |
| 1109 | OTU_1079 | Clostridiaceae | SMB53 | |
| 1110 | OTU_181 | Clostridiaceae | Thermoanaerobacterium | saccharolyticum |
| 1111 | OTU_262 | Caldicellulosiruptoraceae | Caldicellulosiruptor | saccharolyticus |
| 1112 | OTU_431 | Carboxydocellaceae | Carboxydocella | |
| 1113 | OTU_158 | Caulobacteraceae | Asticcacaulis | biprosthecium |
| 1114 | OTU_340 | Caulobacteraceae | Caulobacter | |
| 1115 | OTU_157 | Caulobacteraceae | Caulobacter | |
| 1116 | OTU_243 | Caulobacteraceae | Mycoplana | |
| 1117 | OTU_292 | Caulobacteraceae | Phenylobacterium | |
| 1118 | OTU_341 | | | |
| 1119 | OTU_69 | Methylobacteriaceae | Methylobacterium | |
| 1120 | OTU_149 | Phyllobacteriaceae | Mesorhizobium | |
| 1121 | OTU_54 | Rhizobiaceae | Agrobacterium | |
| 1122 | OTU_3736 | Rhizobiaceae | Agrobacterium | |
| 1123 | OTU_174 | Rhizobiaceae | Rhizobium | |
| 1124 | OTU_3518 | Rhodospirillaceae | Skermanella | |
| 1125 | OTU_245 | Rhodospirillaceae | | |
| 1126 | OTU_289 | Rhodospirillaceae | | |
| 1127 | OTU_242 | | | |
| 1128 | OTU_185 | Erythrobacteraceae | | |
| 1129 | OTU_184 | Sphingomonadaceae | Kaistobacter | |
| 1130 | OTU_304 | Sphingomonadaceae | Kaistobacter | |
| 1131 | OTU_568 | Sphingomonadaceae | Sphingomonas | echinoides |
| 1132 | OTU_23 | Sphingomonadaceae | Sphingomonas | yabuuchiae |
| 1133 | OTU_3351 | Sphingomonadaceae | Sphingomonas | |
| 1134 | OTU_383 | Sphingomonadaceae | Sphingomonas | |
| 1135 | OTU_78 | Sphingomonadaceae | Sphingomonas | |
| 1136 | OTU_3439 | Sphingomonadaceae | Sphingomonas | |
| 1137 | OTU_93 | Sphingomonadaceae | Sphingopyxis | alaskensis |
| 1138 | OTU_199 | Alcaligenaceae | Achromobacter | |
| 1139 | OTU_18 | Burkholderiaceae | Burkholderia | |
| 1140 | OTU_639 | Burkholderiaceae | Burkholderia | |
| 1141 | OTU_2905 | Burkholderiaceae | Burkholderia | |
| 1142 | OTU_64 | Comamonadaceae | Delftia | |
| 1143 | OTU_283 | Comamonadaceae | Hylemonella | |
| 1144 | OTU_215 | Comamonadaceae | Methylibium | |
| 1145 | OTU_3641 | Comamonadaceae | Polaromonas | |
| 1146 | OTU_3253 | Comamonadaceae | Variovorax | paradoxus |
| 1147 | OTU_3420 | Comamonadaceae | Variovorax | |
| 1148 | OTU_236 | Comamonadaceae | | |
| 1149 | OTU_222 | Comamonadaceae | | |
| 1150 | OTU_2922 | Comamonadaceae | | |
| 1151 | OTU_3580 | Comamonadaceae | | |
| 1152 | OTU_443 | Comamonadaceae | | |
| 1153 | OTU_2585 | Comamonadaceae | | |
| 1154 | OTU_50 | Oxalobacteraceae | Herbaspirillum | |
| 1155 | OTU_3392 | Oxalobacteraceae | Janthinobacterium | lividum |
| 1156 | OTU_156 | Oxalobacteraceae | Janthinobacterium | |
| 1157 | OTU_3582 | Oxalobacteraceae | Janthinobacterium | |
| 1158 | OTU_315 | Oxalobacteraceae | Janthinobacterium | |
| 1159 | OTU_2266 | Oxalobacteraceae | Janthinobacterium | |
| 1160 | OTU_2954 | Oxalobacteraceae | Massilia | haematophila |
| 1161 | OTU_2344 | Oxalobacteraceae | Massilia | |
| 1162 | OTU_58 | Oxalobacteraceae | Ralstonia | |
| 1163 | OTU_15 | Oxalobacteraceae | | |
| 1164 | OTU_221 | Oxalobacteraceae | | |
| 1165 | OTU_2199 | Oxalobacteraceae | | |
| 1166 | OTU_1776 | | | |
| 1167 | OTU_507 | | | |
| 1168 | OTU_176 | Methylophilaceae | Methylotenera | mobilis |
| 1169 | OTU_115 | | | |
| 1170 | OTU_3227 | | | |
| 1171 | OTU_165 | Syntrophobacteraceae | | |
| 1172 | OTU_52 | Alteromonadaceae | Cellvibrio | |
| 1173 | OTU_146 | Alteromonadaceae | | |

TABLE M-continued

Core endophytes, including their 16S rRNA sequences, assignment within OTU numbers, family, genus, and species information

| SEQ ID NO. | OTU | Family | Genus | Species |
|---|---|---|---|---|
| 1174 | OTU_1384 | Enterobacteriaceae | Enterobacter | hormaechei |
| 1175 | OTU_35 | Enterobacteriaceae | Enterobacter | |
| 1176 | OTU_2912 | Enterobacteriaceae | Erwinia | |
| 1177 | OTU_319 | Enterobacteriaceae | Escherichia | coli |
| 1178 | OTU_2 | Enterobacteriaceae | Pantoea | agglomerans |
| 1179 | OTU_1255 | Enterobacteriaceae | Pantoea | ananatis |
| 1180 | OTU_3489 | Enterobacteriaceae | Pantoea | |
| 1181 | OTU_2970 | Enterobacteriaceae | | |
| 1182 | OTU_3078 | Enterobacteriaceae | | |
| 1183 | OTU_3153 | Enterobacteriaceae | | |
| 1184 | OTU_145 | Coxiellaceae | Aquicella | |
| 1185 | OTU_379 | Coxiellaceae | Aquicella | |
| 1186 | OTU_390 | Coxiellaceae | Aquicella | |
| 1187 | OTU_209 | Coxiellaceae | Aquicella | |
| 1188 | OTU_197 | Coxiellaceae | | |
| 1189 | OTU_3292 | Pasteurellaceae | Haemophilus | parainfluenzae |
| 1190 | OTU_363 | Pasteurellaceae | Haemophilus | |
| 1191 | OTU_155 | Moraxellaceae | Acinetobacter | rhizosphaerae |
| 1192 | OTU_216 | Moraxellaceae | Acinetobacter | |
| 1193 | OTU_2544 | Pseudomonadaceae | Pseudomonas | viridiflava |
| 1194 | OTU_11 | Pseudomonadaceae | Pseudomonas | |
| 1195 | OTU_7 | Pseudomonadaceae | Pseudomonas | |
| 1196 | OTU_3276 | Pseudomonadaceae | Pseudomonas | |
| 1197 | OTU_3748 | Pseudomonadaceae | Pseudomonas | |
| 1198 | OTU_3228 | Pseudomonadaceae | Pseudomonas | |
| 1199 | OTU_204 | Pseudomonadaceae | Pseudomonas | |
| 1200 | OTU_2653 | Pseudomonadaceae | Pseudomonas | |
| 1201 | OTU_144 | Xanthomonadaceae | Arenimonas | |
| 1202 | OTU_3850 | Xanthomonadaceae | Dokdonella | |
| 1203 | OTU_177 | Xanthomonadaceae | Luteimonas | |
| 1204 | OTU_194 | Xanthomonadaceae | Lysobacter | |
| 1205 | OTU_527 | Xanthomonadaceae | Rhodanobacter | |
| 1206 | OTU_168 | Xanthomonadaceae | Rhodanobacter | |
| 1207 | OTU_83 | Xanthomonadaceae | Stenotrophomonas | |
| 1208 | OTU_2829 | Xanthomonadaceae | Stenotrophomonas | |
| 1209 | OTU_382 | Xanthomonadaceae | Xanthomonas | axonopodis |
| 1210 | OTU_334 | Leptospiraceae | Turneriella | |
| 1211 | OTU_89 | Mycoplasmataceae | Mycoplasma | |
| 1212 | OTU_214 | auto67_4W | | |
| 1213 | OTU_385 | Opitutaceae | Opitutus | |
| 1214 | OTU_252 | Opitutaceae | Opitutus | |
| 1215 | OTU_279 | Opitutaceae | | |
| 1216 | OTU_280 | Verrucomicrobiaceae | Luteolibacter | |
| 1217 | OTU_172 | Verrucomicrobiaceae | Luteolibacter | |

Example 8: Introducing *Burkholderia phytofirmans* Strain PsJN into Winter Wheat Seeds The concept of internal seed colonization with plant growth promoting microorganisms according to the present invention was tested with the endophytic bacterium *Burkholderia phytofirmans* stain PsJN and a plant variety of winter wheat (*Triticum aestivum* cv. Pannonikus). Strain PsJN was applied by spraying flowering heads on Jun. 7, 2013 in a farmer field near Staasdorf (close to the AIT laboratories in Tulln, lower Austria). In that field, grown with winter wheat cultivar Pannonikus (Austrian variety from the company Saatbau Linz), an area of about 10 m² was marked and sprayed with a suspension of $10^8$-$10^9$ CFU mL$^{-1}$ (V1). Directly next to that plot, another plot of 10 m² was marked as control (V2), which was not treated. Both plots were hand-harvested at maturity. Harvested heads were packed separately in bags and brought to Tulln, where they were lab-threshed and stored in separate bags. At maturity, about 25% of all winter wheat seeds analyzed carried PsJN cells. Experiments were performed to determine the effects of internally colonized winter wheat seeds (V1) on offspring plant germination as compared to seed of the same variety, grown next to V1 in the same field during growing season 2013 (V2). In addition, V3 seed (untreated) of the same variety (Pannonikus) was acquired from the breeder before planting in fall 2013. This was to test for any (potentially negative) effects that the usage of "re-grown" seed (V1 and V2 are "re-grown" seed, as the farmer field where V1 and V2 were produced was a grain-production field and not an officially certified seed-production field) might have on the general quality of V1 and V2 trial seed.

Experiment Description

The present invention provides seeds having beneficial microorganisms located internally in the seed compartment, enabling improved plant biomass production relative to a control group equal to applying the same microorganisms exogenously to seed coats. Strain PsJN was used as a test strain to test flower inoculation into seeds in a winter wheat cultivar (Pannonikus). Two sets of experiments are designed to: (A) evaluate strain PsJN colonization potential in different tissues of winter wheat plants (particularly grains); and (B) follow-up evaluation of strain PsJN colonized seed to improve plant germination, biomass production and yield over controls.

Growth of PsJN Strain as Bacterial Inoculum

Figure 31:
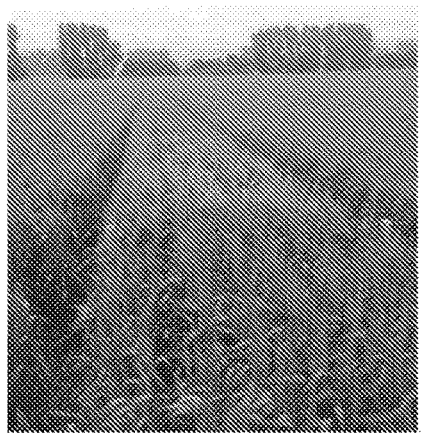
FIG. 31. Outdoor generation of seeds colonized with desired endophytes. A), B), C) Contacting winter wheat in the field during flowering with a solution of the heterologous hormone-producing endophyte PsJN to allow uniform colonization of the subsequent seeds.
Figure 31:
Figure 31:
Figure 32:
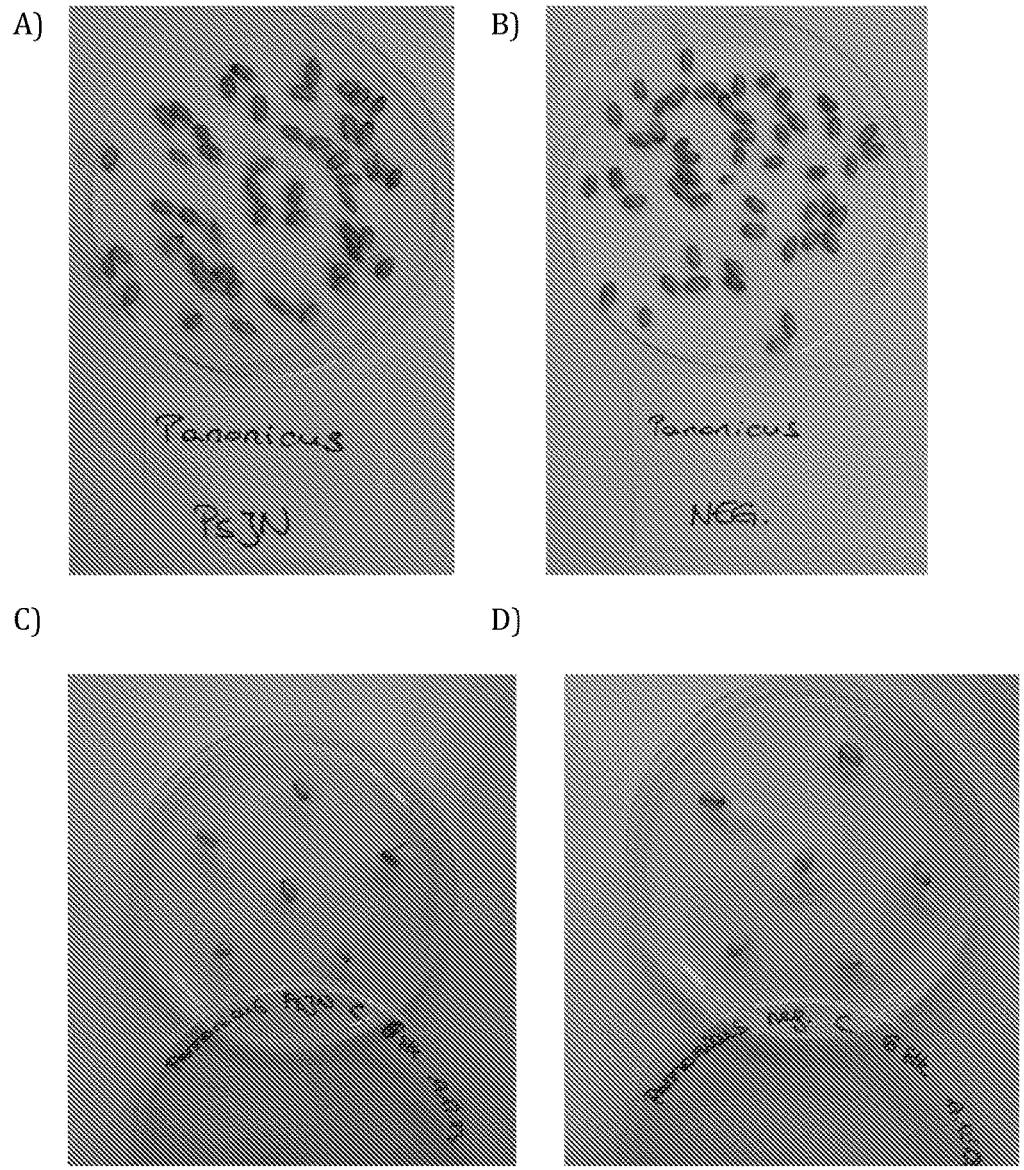
FIG. 32. Successful germination of wheat seeds colonized with heterologous endophytes. A) Appearance of Panonicus variety winter wheat seeds harboring the heterologous hormone-producing endophyte PsJN. Seeds appear slightly larger with normal morphology; B) Control Panonicus variety winter wheat seeds without PsJN; C) Successful germination of Panonicus variety winter wheat seeds harboring the heterologous hormone-producing endophyte PsJN; D) Control Panonicus variety winter wheat seeds without PsJN FIG. 33. A) Successful germination of Panonicus variety winter wheat seeds harboring the heterologous endophyte S10; B) Successful germination of Panonicus variety winter wheat seeds harboring the heterologous endophyte PsJN; C) Control Panonicus variety winter wheat seeds without PsJN FIG. 34. Successful germination of maize hybrid seeds uniformly containing novel endogenous and heterologous endophytes. A) Successful germination of maize seeds harboring the heterologous endophyte S10. B) Successful germination of maize seeds harboring the endogenous endophyte S4; C) Successful germination of maize seeds harboring the heterologous endophyte PsJN; D) Germination of control maize; E) Successful germination of maize seeds harboring the endogenous endophyte S10; F) Successful germination of maize seeds harboring the endogenous endophyte S4; G) Successful germination of maize seeds harboring the endogenous endophyte PsJN; H) Germination of control maize seeds.
Figure 33:
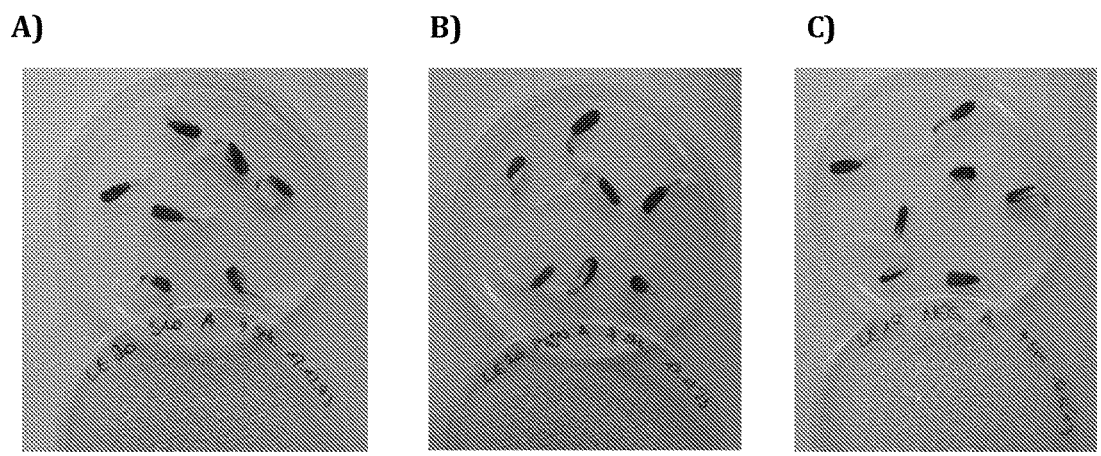
Figure 34:
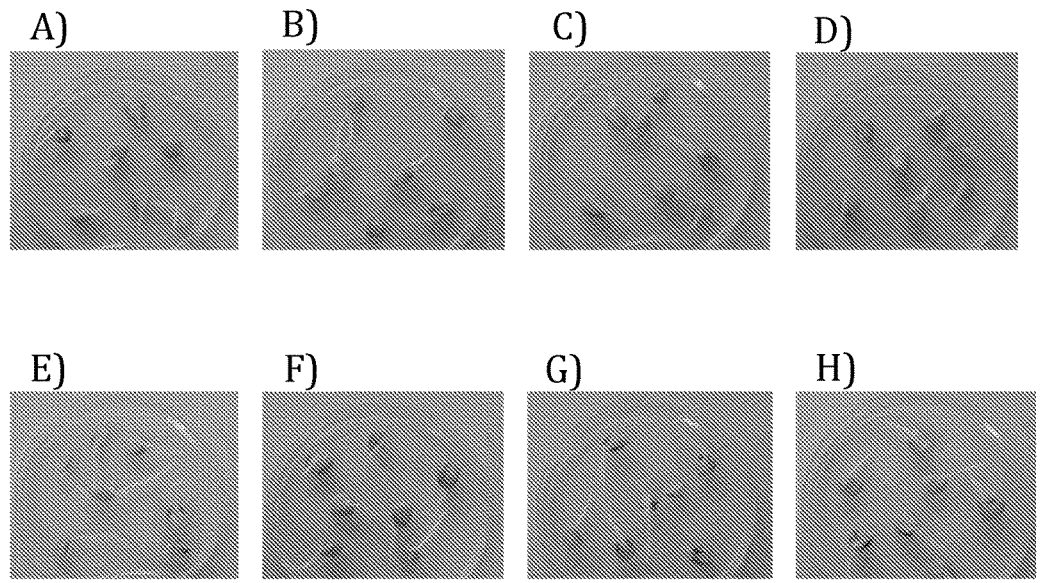

The bacterial strain was grown by loop-inoculating one single colony in LB broth amended with spectinomycin (100 µg mL$^{-1}$) in 100 mL flasks. The bacterial culture was incubated at 28° C. for 2 days at 180 rpm in a shaking incubator. The bacterial inoculum was applied by spraying inoculum at flowering stage using a standard pressure sprayer (max. volume 3.6 L; 0.98 L/min/3 bar), as shown in FIGS. 31 *a*, *b*, and *c*. Control plants were sprayed with sterile media. Bacterial inoculum was specifically sprayed to the female flower when the crop reached flowering stage on a 10 m$^2$ plot in a farmer field where they were allowed to mature under standard field conditions and harvested at maturity, i.e., at the same time as the farmer combined the remainder of this field. Seeds obtained from the inoculated flowers (V1) were used for the next set of experiments, as well as the control (V2) from the same farmer field (see FIGS. 32, 33, and 34).

Endophytic Colonization by PsJN Strain (Particularly Grain Colonization)

Prior to the plant experiments, seeds of inoculated flowers as well as control seeds were tested to see whether PsJN cells are present. For this purpose, 24 seeds were surface-sterilized with 70% ethanol (3 min), treated with 5% NaOHCl for 5 min, and followed by washing 3 times with sterile distilled water (1 min each time). The efficacy of surface sterilization was checked by plating seed, and aliquots of the final rinse onto LB plates. Samples were considered to be successfully sterilized when no colonies were observed on the LB plates after inoculation for 3 days at 28° C. Surface-disinfected seeds were cut in pieces and crushed using a sterile mortar. The seed material was transferred to Matrix E (MPbio DNA isolation kit from soil) homogenized by 30 sec beat beating using in a bead beater (FastPrep FP 120, Bio101, Savant Instruments, Inc., Holbrook, N.Y.). DNA was extracted with the MPbio DNA isolation kit from soil (MP Biomedicals, Solon, Ohio, USA) according to protocol provided by the manufacturer. A single seed was used for DNA isolation. For each seed, the IGS region of PsJN was amplified using the pHr primer (Massol-Deya et al. 1995) and one of twenty-four different variants of the IGS forward (P23SR01) primer (Massol-Deya et al. 1995) (IGSFw T1 to T24) containing a 10 bp long overhang (barcode) on the 5'end. PCR amplifications were performed with a thermocycler (PTC-100™, MJ Research, Inc.) using an initial denaturation step of 5 min at 95° C. followed by 30 cycles of 30 s at 95° C., 1 min annealing at 52° C. and 2 min extension at 72° C. PCR reaction mixtures (50 µl) contained 1× reaction buffer (Gibco, BRL), 200 µM each dATP, dCTP, dGTP and dTTP, 2 mM MgCl$_2$ and 2.5 U Taq DNA polymerase (Gibco, BRL), 0.2 µM each of the primers and 1 µl extracted DNA. PCR products were pooled and purified by using a QIAquick™ PCR Purification kit (QIAGEN GmbH, Hilden, Germany). DNA fragments were ligated into the vector pSC-A-amp/kan (Strata Clone PCR Cloning Kit, Stratagene, Agilent Technologies, Santa Clara, Calif., USA) and the ligation products were transformed into competent *E. coli* cells (StrataClone SoloPack Competent Cells, Agilent Technologies, Santa Clara, Calif., USA) according to the manufacturer's instructions. Two hundred clones per library, appearing as white colonies on indicator plates containing X-Gal (5-bromo-4-chloro-3-indolyl-β-D-galactopyranoside) and IPTG (isopropyl-β-thiogalactopyranoside) were picked, re-suspended in 10 µl sterile water and boiled for 5 min at 95° C. Two µl of the supernatant were used as template for PCR amplification with the primers M13f (5'-TGTAAAACGACGGCCAGT-3'; SEQ ID 1227) and M13r (5'-GGAAACAGCTATGACCATG-3'; SEQ ID 1228) to amplify cloned inserts. PCR was performed in a total volume of 50 µl and contained in addition to the template DNA, 1×PCR reaction buffer (Invitrogen), 3 mM MgCl$_2$, 0.2 µM of each primer, 0.2 mM of each deoxynucleoside triphosphate, and 2.5 U Taq DNA polymerase (LifeTech, Vienna, Austria). Cycler conditions were as following: 5 min denaturation at 95° C., 30 cycles consisting of denaturation for 30 sec at 95° C., primer annealing for 1 min at 50° C., polymerization for 2 min at 72° C., and final extension for 10 minutes at 72° C. PCR products (5 µl) were checked by electrophoresis in 0.8% (w/v) agarose gels (Biozym Biotech Trading, Vienna, Austria. Clones were sequenced with the primers M13r and M13f, respectively, making use of the sequencing service of LGC Genomics AGOWA (Berlin, Germany). Retrieved sequences were visualized, vector sequences were removed and sequences assembled with sequence alignment editor package of BioEdit (Ibis Biosciences, Carlsbad, Calif., USA). Sequences within a library were dereplicated and grouped using FastGroupII (http://fastgroup.sdsu.edu/fg_tools.htm). For identification representative sequences of each group were subjected to the Basic Local Alignment Search Tool (BLAST) analysis with the National Center for Biotechnology Information (NCBI) database (http://blast.ncbi.nlm.nih.gov/Blast.cgi).

Effect of PsJN on Germination and Yield

Figures 36, 37:
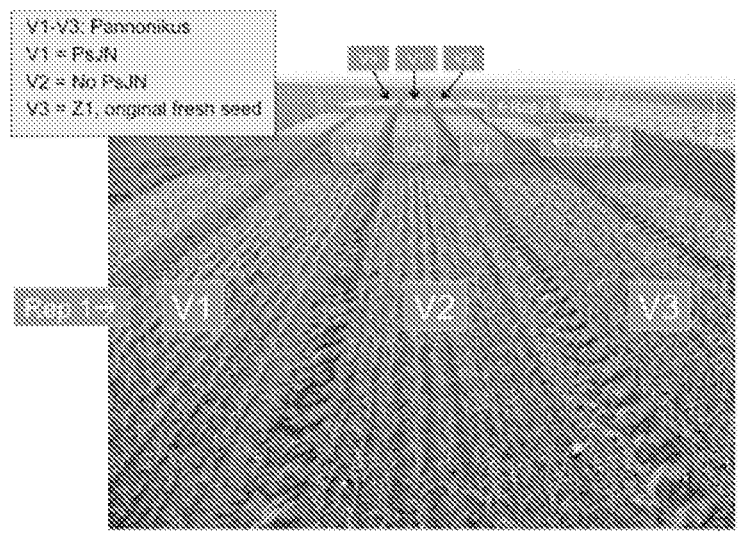
FIG. 36 shows the layout of the winter wheat yield trial near Raasdorf, Lower Austria. V1-V3 are the variety treatments, Border plots are marked as "Border". Numbers in the treatment plots starting "16**" are unique identifiers for each plot.
FIG. 37 shows the winter wheat yield trial near Raasdorf, Lower Austria. V1-V3 grown in a total of 9 plots (V1-V3 denote 3 variety treatments, Rep 1-Rep 3 show 3 replications). As seen on the picture, variety treatments V1-V3 were randomized within each replication. In order to minimize border effect of bordering plots of V1-V3, border plots were grown, 3 to the left and 3 to the right, unmarked in the picture. V1 is planted from seed sprayed with PsJN, V2 is from seed grown as control in the farmer field near Tulbing during 2013. V3 is original seed obtained from the breeder/distributor. V1-V3 are all of the winter wheat cultivar Pannonikus.

Seeds were planted on Oct. 23, 2013 at a field near Raasdorf in Lower Austria, Austria. The intention of the trial is to provide yield data and data on general agronomics, such as germination and plant height. The layout as well as planting and trial management is standard procedure for such trials and conducted exactly in the same manner as e.g., as seed companies do to test new genetics and as the Official Registration Authorities do in crop registration trials (See FIG. 36). There were 10 rows per plot with a distance of 12 cm between rows. Three replicates of each plot/condition were randomized, as described in FIG. 37. Seeding density was 450 seeds/m$^2$, planting depth was 3-4 cm. Planting was conducted by a small-plot drill planting machine Wintersteiger Plot Seed TC). Fertilizer (standard 120 kg N) was delivered in 3 applications: 1st in spring at EC24, 2$^{nd}$ at tiller EC 32, 3$^{rd}$ corn filling EC43. Plants were treated with herbicide (Starane, KWIZDA, Austria) once but no fungicide was applied. Plots were harvested on Jul. 21, 2014 with a Wintersteiger Nursery Master harvesting machine. Yield data and agronomic characteristics are summarized in Table N and Table O. Harvest Moisture was measured with the Standard Wintersteiger moisture meter on the harvester (capacitive system), thousand kernel weight (TKW) was determined once per plot by counting kernels on a Contador seed counter and weighing the seeds on a balance. HL weight was measured once per plot making use of a standardized HL volume-cup (¼ liter) and plant height by a meter stick at the time points given in the table. Yield was calculated based on plot fresh weight and harvest moisture and calculated to 14% moisture for all plots.

Results Example 8

Winter Wheat Seed Colonization by Strain PsJN

The ability of strain PsJN to colonize winter wheat seeds was analyzed in plants treated by specific flower inoculation (by spraying), as compared to untreated seeds. Inoculation of flowers resulted in internal colonization of seeds. IGS region-PCR cloning and sequencing resulted in about 90 sequences matching the quality criteria for subsequent analysis each for seeds of PsJN-treated and non-treated plants. After removing chimeric and wheat plastid sequences the PsJN-endoseed library sequences grouped in a total number of 54 sequence groups and 59 groups in case of control seeds. IGS sequences of the PsJN-endoseed library could be assigned to seven different bacterial species with the majority of sequences showed highest homology to *Ralstonia pickettii*. Sequences derived from control seeds originate from seven bacterial species with *Ralstonia pickettii* again being the most dominant species.

The primer tags used for barcoding of single seeds were not evenly distributed within the library of sequences. Out of 24 tags used 16 tags were found again, meaning that we had sequences of 16 individual seeds in the sequence library. The sequences were clustered due to the barcode and within four sequence clusters we found the IGS of *B. phytofirmans* PsJN. Thus, 25% of PsJN-endoseeds contained *B. phytofirmans* PsJN but PsJN was not detected in any of the control seeds.

Effect of PsJN on Germination of Winter Wheat

As described in Table N, treatment V1 (PsJN inside of the seed) increased the percentage germination average within all three replicates repeats by 10% and 4% when compared to seeds coming from controls V2 and V3, respectively.

In both summer wheat cultivars sprayed with PsJN we found that PsJN-endoseed (V1) yielded 7.5% over the control variety (V3), which was original seed (Z1 seed) of the same variety Pannonikus (Table 0). On the other hand, seed not treated with PsJN but derived from the same field (V2) as PsJN treated seed, yielded below the PsJN treated seed, still higher than the Z1 control. We conclude that PsJN-endoseed is actually the variety with the highest yield.

TABLE N

Germination was measured by counting a sample of germinating seeds in each plot, and providing data per plot as well as an average of all 3 replications per variety treatment. "% germinated" is the number of germinated seeds divided by the seeding density of 450 seeds/m$^2$.

| Plot | Treatment* | Plants germinated/ m$^2$ | % germinated | Plants germinated/ m$^2$ average | % germinated average |
|------|-----------|-------------------------|--------------|----------------------------------|----------------------|
| 1618 | V1 | 382.22 | 84.94 | | |
| 1623 | V1 | 364.44 | 80.99 | 376.38 | 83.62 |
| 1625 | V1 | 382.22 | 84.94 | | |
| 1619 | V2 | 333.33 | 74.07 | | |
| 1621 | V2 | 333.33 | 74.07 | 330.37 | 73.42 |
| 1626 | V2 | 324.44 | 72.1 | | |
| 1620 | V3 | 351.11 | 78.02 | | |
| 1622 | V3 | 373.33 | 82.96 | 355.56 | 79.01 |
| 1624 | V3 | 342.22 | 67.05 | | |

*Treatment V1: Sprayed with PsJN in farmer field 2013
V2: Control in farmer field 2013
V3: Original (Z1) seed of the same variety bought in fall 2013 from seed distributor

TABLE O

Effect of seed colonizing-PsJN on yield and plant height of winter wheat (cv. *Pannonikus*) plants.

| treatment | Moisture % | HL weight (kg) | TKW (g) | Ave. Plant height (cm) 197 days | Ave. Plant height (cm) 215 days | Ave. Plant height (cm) 271 days | Yield difference to lowest yield |
|-----------|-----------|----------------|---------|--------------------------------|--------------------------------|--------------------------------|----------------------------------|
| V1 | 16.12 | 78.83 | 51.70 | 69.13 | 95.73 | 92.77 | 7.47% |
| V2 | 16.10 | 79.22 | 53.10 | 69.40 | 94.60 | 91.20 | n/a |
| V3 | 15.75 | 77.62 | 51.07 | 71.47 | 94.87 | 92.13 | n/a |

* Treatment V1: Sprayed with PsJN in farmer field 2013
V2: Control in farmer field 2013
V3: Original (Z1) seed of the same variety bought in fall 2013 from seed distributor Conclusions for Example 8

*Burkholderia phytofirmans* PsJN can be introduced into winter wheat seeds by spraying cells onto flowers. Seeds obtained from PsJN-sprayed flowers show substantial increase in germination and yield of field grown winter wheat.

Example 9: Production of Endoseeds with Endophytes of Different Taxa and Origin

Experimental Description

In this example, we describe the production of summer wheat (*Triticum aestivum* cvs. Trappe and Kronjet), winter wheat (*Triticum aestivum* cv. Pannonikus), soy (*Glycine max* cvs. Essor and Merlin), and barley (*Hordeum vulgare* cv. Eunova and Calcule) endoseeds colonized by endophytes from different origin and taxonomy (*Burkholderia phytofirmans* PsJN and *Paenibacillus* sp. S 10).

Summer wheat and barley endoseed production was as follows: 10 by 1.3 m plots were planted on Mar. 13, 2014 with summer wheat (Trappe and Kronjet cultivars) at a density of 180 kg/ha and barley (Calculae and Eunova) at a density of 150 kg/ha in a field located in Tulln, Austria. Plants got sprayed with herbicide once (Apr. 23, 2014; 1.25 l/ha Andiamo Maxx) and fertilized twice on Apr. 3, 2014. NPK-Fertilzer 16:6:18+5S was applied at a concentration of 300 kg/ha and on May, 9 2014 N-Fertilzer 27% was applied at a concentration of 220 kg/ha. At flowering time, each plot was sprayed twice (wheat: Jun. 4 and Jun. 12, 2014; barley: June 2 and June 10) with one of the treatments as indicated in Table P.

TABLE P

Bacterial strains used to spray flowers of summer wheat and barley plants with the aim of introducing the stains into seeds.

| Treatment | Taxonomy | Origin |
|-----------|----------|--------|
| S10 | *Paenibacillus* sp. | Maize (cv. PESO) seed |
| PsJN | *Burkholderia phytofirmans* | Onion roots |
| TC38 | *Flavobacterium* sp | Maize (DK315) roots |
| AB | *Aneurinibacillus* sp. | Summer wheat (KWS Collada) seed |
| PsJN + S10 | | |
| Mock (negative control) | | |

The bacterial inoculant used for spraying summer wheat and barley was prepared as follows: endophytes were streaked on large (diameter: 14.5 cm) 20% TSA (Tryptic Soy Agar) plates, grown at 28° C. for 2 days, scraped from the plates and resuspended in 2 L of 1×PBS supplemented with 20 g zeolite (used as a carrier) and 2004 Silwet L-77 (used as a surfactant) (final OD600 of about 0.1). Suspensions were filled into spraying bottles and each plot was sprayed with 1 L of the corresponding treatment. For the simultaneous application of PsJN and S10 1 L bacterial suspension each was prepared as described above and mixed carefully before adding zeolite and the surfactant. Negative control plots were sprayed with 1×PBS containing zeolite and Silwet. Only 10 whole spikes per plot were harvested for further colonization analysis. Remaining plants were harvested, threshed and stored.

Winter wheat PsJN endoseed production was as follows: two 10 m² plots were planted with winter wheat (Pannonikus cultivar) seeds at a density of 180 kg/ha in a field located in Tulln, Austria. One plot was sprayed with *B. phytofirmans* PsJN and the second plot used as an untreated control.

The bacterial inoculant used for spraying winter barley was prepared as follows: 10 mL of 10% TSB (Tryptic Soy Broth) were inoculated with a single colony of *B. phytofirmans* PsJN and incubated at 28° C. and shaking overnight. The culture was then transferred to 200 mL 10% TSB and incubated at 28° C. and shaking for 24 h. This culture was transferred to 2.4 L 10% TSB and incubated at 28° C. and shaking for an additional 24 h. The bacterial culture was adjusted to an $OD_{600}$ of 0.5 yielding in 3.5 L of bacterial suspension. 24 g of zeolite was added and mixed in the suspension right before spraying. Wheat flowers were sprayed on Jun. 7, 2014 until covered by a grey film of zeolite.

Both plots were harvested manually yielding about 10 kg each. The ears were threshed with a standard lab threshing. 10 ears per treatment were kept intact for the analysis of variations on single ears.

Soy endoseed production was as follows: eighty soy seeds of each variety (Merlin and Essor cultivars) were sown into a mixture of Einheitserde special—Topfsubstrat ED 63 and perlite in a proportion of 5:3 in a greenhouse chamber at the AIT in Tulln, Austria. Ten days after sowing 55 seedlings each were individually potted into 1 L (12×12×12 cm) pots containing substrate as described above. Plants were watered automatically twice a week by flooding for 10 min. Plants were fertilized once with 3% "Wuxal Super". At flowering time, each pot was sprayed three times (30, 35 and 39 days after sowing) with one of the treatments as indicated in Table Q. Each treatment was applied on ten plants per cultivar.

TABLE Q

Bacterial strains used to spray flowers of soy plants with the aim of introducing the stains into seeds.

| Treatment | Taxonomy | Origin |
|---|---|---|
| S10 | *Paenibacillus* sp. | Maize (cv. PESO) seed |
| PsJN | *Burkholderia phytofirmans* | Onion roots |
| TC38 | *Flavobacterium* sp | Maize (DK315) roots |
| NC92 | *Bradyrhizobium japonicum* | |
| Mock (negative control) | | |

The bacterial inoculant used for spraying soy was prepared as follows: 5 ml trypic soy broth (10%) were inoculated with single colonies of endophytes and incubated overnight at 28° C. in a rotary shaker. 5 overnight cultures per endophyte were pooled and cells harvested by centrifugation at 4,700 rpm and room temperature. The supernatant was discarded and the pellet resuspended in 1×PBS buffer to a final OD 0.2 (about 25 ml). Suspensions were filled into 50 ml-nebulizers and used to spray 20 plants.

Endophytic Colonization by PsJN Strain (Particularly Grain Colonization)

Quantification of PsJN in endoseeds from summer wheat, winter wheat, barley and soy was determined with qPCR. Seeds were surface-sterilized by soaking the seeds in 70% ethanol for 3 min followed by 5% sodium hypochloride for 5 min, and washed three times with sterile distilled water (1 min for each wash). Seeds and aliquots of the final wash were plated on LB plates to verify the efficiency of surface sterilization. Seeds were considered to be successfully sterilized when no colonies were observed on the LB plates after inoculation for 3 days at 28° C. Single surface-sterilized seeds were aseptically peeled using a scalpel, cut in pieces and crushed using a sterile mortar. Seed material was homogenized for 30 s in lysing matrix E (MPbio DNA isolation kit from soil) using in a bead beater (FastPrep FP 120, Bio101, Savant Instruments, Inc., Holbrook, N.Y.). DNA was then extracted with the MPbio DNA isolation kit from soil (MP Biomedicals, Solon, Ohio, USA) according to protocol provided by the manufacturer.

For quantification of *Burkholderia phytofirmans* PsJN, the obtained DNA from the isolation steps was used to perform a quantitative real time PCR using a Taqman probe and a Biorad CFX96 real-time detection system. The probe was designed in a previous study to match the DNA amplicon (transcription termination factor rho) produced by the primers 1824 Forward and 1824 Reverse (Bphyt_1824 Fw and Re). The sequence of the forward primer was AAAAAC-GAGCCAAAAGGGC (5'→3'), SEQ ID 1229, the sequence of the reverse primer was CGTTATTTCGCGCTGGTG (5'→3'), SEQ ID 1230. The sequence of this probe was AAACCTCGTACCTCGCCAGC (5'→3'), SEQ ID 1377. The probe is equipped with a FAM (6-FAM-phosphoramidit-fluorescent dye) on the 5' end, and a BHQ-1 (Black hole quencher 1) on the 3' end. A BioRad SsoFast Probe Supermix was used to provide the ideal conditions for the probe during the PCR.

For qPCR standard preparation, chromosomal DNA of *B. phytofirmans* PsJN was isolated using FastDNA™ SPIN Kit for soil (MP Biomedicals, LLC) according the manufacter protocol. DNA concentration was determined using a Nanotrop and doing five replicate measurements. The mean value was used for further calculations. The number of DNA copies was calculated as follows:

$$\text{number of copies} = \frac{DNA \text{ quantity}\left(\frac{g}{\mu l}\right)}{\text{fragment length}*660 \text{ g/mol}} * 6.022 * 10^{23}$$

where fragment length is 8214658 bp (size of PsJN genome). A dilution series was prepared to generate a standard curve.

Detection of PsJN in Soy Plant Tissue (Seeds) Using DOPE-FISH

For microscopy analysis, plant samples were used and cut in small parts (0.5-cm long sections). Samples were then fixed overnight at 4° C. in a paraformaldehyde solution (4% in PBS pH 7.2), and rinsed twice in PBS. Treatment with a lysozyme solution (1 mg $mL^{-1}$ in PBS) was then applied to the samples for 10 min at 37° C. before being dehydrated in an ethanol series (25, 50, 75 and 99.9%; 15 min each step). Fluorescence in situ hybridization using double labeling of oligonucleotide probes (DOPE-FISH) was carried out using probes from Eurofins (Germany) labeled at both the 5' and 3' positions. An EUBmix (equivalent mixture of EUB338, EUB338II, EUB338III) coupled with a ATTO488 fluorochrome (Amann et al. (1990), Nature reviews microbiology 6: 339-348; Daims et al. (1999), Syst Appl Microbiol 22: 434-444), and a probe for *B. phytofirmans* coupled with Cy5 were used (probe B.phyt unpublished, created by S. Compant based on 23S rRNA gene sequence and probe design; as described in Example 3). NONEUB probe (Wallner et al. (1993), *Cytometry* 14: 136-143) coupled with Cy5 or ATTO488 was also used independently as a negative control. Hybridization was carried out at 46° C. for 2 h with 10-20 µL solution (containing 20 mM Tris-HCl pH 8.0, 0.01% w/v SDS, 0.9 M NaCl, formamide at the concentration suited to the probe, and 10 ng $\mu L^{-1}$ of each probe) applied to each plant sample placed on slides in a 50-mL moist chamber (also housing a piece of tissue imbibed with 5 mL hybridization buffer). Washing was conducted at 48° C. for 30 min with a post-FISH pre-warmed solution containing 20 mM Tris-HCl pH 8.0, 0.01% (w/v) SDS, 5 mM EDTA pH 8.0 and NaCl at a concentration corresponding to the formamide concentration. Samples were then rinsed with distilled water before air drying for at least 1 day in the dark. The samples were then observed under a confocal microscope (Olympus Fluoview FV1000 with multiline laser FV5-LAMAR-2 HeNe(G)laser FV10-LAHEG230-2). X, Y, Z pictures were taken at 405, 488, 633 nm and then merged (RGB) using Image J software. Z Project Stacks was then used to create the pictures (as described in Campisano et al. (2014), *Mol Biol Evol* 31: 1059-1065)).

Results Experiment 9

Seed Colonization by Strain PsJN Analyzed by qPCR

The results summarized in Tables R and S show that *B. phytofirmans* PsJN could be successfully introduced into seeds of summer wheat, soy and winter wheat by spraying the flowers of the parent plants.

In both summer wheat cultivars sprayed with PsJN we found the strain to be effectively introduced into the seeds—21 (Trappe) or 22 (Kronjet) out of 24 seeds, respectively were tested positive in PsJN specific qPCR assays (up to 92% of wheat seeds were colonized by PsJN upon spraying of parent flowers). The PsJN cell number per seed varied strongly and reached up to 28000 in selected samples (cv. Kronjet). Simultaneous application of *B. phytofirmans* PsJN with another bacterial strain (*Paenibacillus* sp. S10) was less efficient. Only seeds of cultivar Kronjet were colonized by PsJN with 13 out of 24 analyzed seeds being positive in PsJN specific qPCR and the cell number within seeds ranged between 100 and 2000.

PsJN was not found in seeds of barley plants sprayed with the strain. However, we found PsJN in the respective negative controls. Two out of 24 seeds of both barley cultivars tested contained PsJN. In this context, it needs to be explained that summer wheat and barley endoseeds were produced in one field. When the plants were sprayed (twice during flowering) the weather conditions were extremely windy and the spray solutions were distributed across the plots. Taking this into account cross contaminations were to be expected. The cell number in the PsJN-colonized cells of the negative control however was relatively low ranging between 120 and 190 cells per seed.

To exclude the possibility that PsJN is naturally occurring in wheat and barley seeds used to produce endoseeds in the field original seeds/seeds of the parental generation were tested with the PsJN-specific qPCR. No signal was found in any of the tested seed samples.

Winter wheat (cv. Pannonikus) endoseeds were produced in a field. PsJN was not detected in the seeds derived from the not treated field plot or the original seeds bought from the producer but two out of 24 (8%) seeds of sprayed plants gave a positive signal in PsJN specific qPCR.

In the case of soy the endoseed production was done in the greenhouse and no cross-contamination during spray application of *B. phytofirmans* PsJN occurred. The negative control did not give a positive signal PsJN specific qPCR. The colonization efficiency was different in the two soy cultivars tested. Two out of twelve (17%) seeds of cultivar Merlin contained PsN cells whereas six out of 12 (50%) seeds of cultivar Essor were found to harbor PsJN. The two soy cultivars tested differ in the maturity, with Essor being early maturing (00) and Merlin very early maturing (000). The flowers of both cultivars were sprayed at the same day. Differences in the developmental stage of flowers could thus have influenced the susceptibility of soy flowers to invading PsJN cells. The number of PsJN cells detected in soy seeds (based on qPCR) ranged from about 360 to about 4500 cells per seed.

TABLE R (a) Number of seeds colonized by PsJN out of sample size indicated and range of numbers of copies of PsJN within colonized seeds. PsJN identification was done by qPCR.

| Plant species | Negative control* | | Original seed (parental generation, untreated)# | |
|---|---|---|---|---|
| | Colonized/ tested seeds | copies per seed | Colonized/ tested seeds | copies per seed |
| Summer wheat (Trappe) | 0/24 | 0 | 0/3 | 0 |
| Summer wheat (Kronjet) | 15/24 | 1.7E+2 to 7.2E+03 | 0/3 | 0 |
| Barley (Calucle) | 2/24 | 1.2E+02 to 2.4E+02 | 0/3 | 0 |
| Barley (Eunova) | 2/24 | 1.9E+02 to 2.69E+02 | 0/3 | 0 |
| Soy (Merlin) | 0/24 | 0 | n.d. | n.d. |
| Soy (Essor) | 0/24 | 0 | n.d. | n.d. |
| Winter wheat (Pannonikus) | 0/24 | 0 | 0/8 | 0 |

*Control in field or greenhouse
Original seed of the same variety

TABLE S (a) Number of seeds colonized by PsJN out of sample size indicated and range of numbers of copies of PsJN within colonized seeds.

| | PsJN* | | PsJN + S10# | |
|---|---|---|---|---|
| | Colonized/ tested seeds | copies per seed | Colonized/ tested seeds | copies per seed |
| Summer wheat (Trappe) | 21/24 | 2.66E+02 to 6.88E+03 | 0/24 | 0 |
| Summer wheat (Kronjet) | 22/24 | 4.7E+02 to 2.8E+04 | 13/24 | 1.23E+02 to 1.98E+03 |
| Barley (Calucle) | 0/24 | 0 | 0/24 | 0 |
| Barley (Eunova) | 0/24 | 0 | 0/24 | 0 |
| Soy (Merlin) | 2/12 | 3.66E+02 to 1.64E+03 | n.d. | n.d. |

TABLE S-continued (a) Number of seeds colonized by PsJN out of sample size indicated and range of numbers of copies of PsJN within colonized seeds.

| | PsJN* | | PsJN + S10# | |
|---|---|---|---|---|
| | Colonized/ tested seeds | copies per seed | Colonized/ tested seeds | copies per seed |
| Soy (Essor) | 6/12 | 7.29E+02 to 4.50E+03 | n.d. | n.d. |
| Winter wheat (Pannonikus) | 2/24 | 1.5E+02 to 7.6E+02 | n.d. | n.d. |

Figure 38:
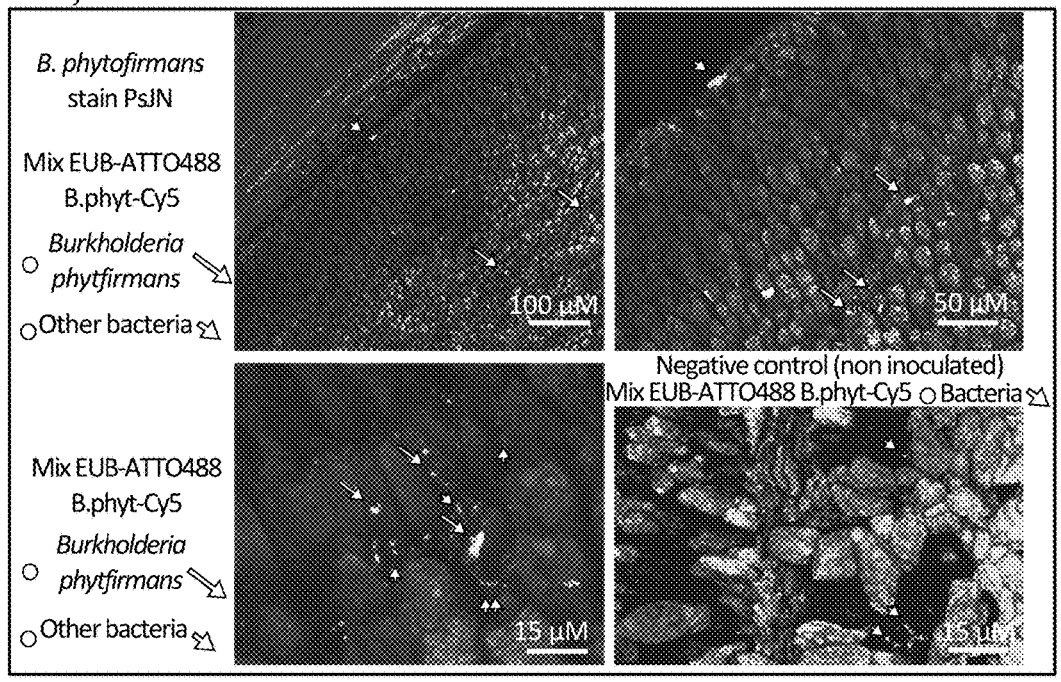
FIG. 38 shows microphotographs of DOPE-FISH-confocal microscopy A) shows cells of *B. phytofirmans* (yellow) among native bacteria (green) in soy seeds and native bacteria in control seeds. B) shows results using NONEUB probes in soy seed colonized by *B. phytofirmans* PsJN or control seeds.
Figure 38:
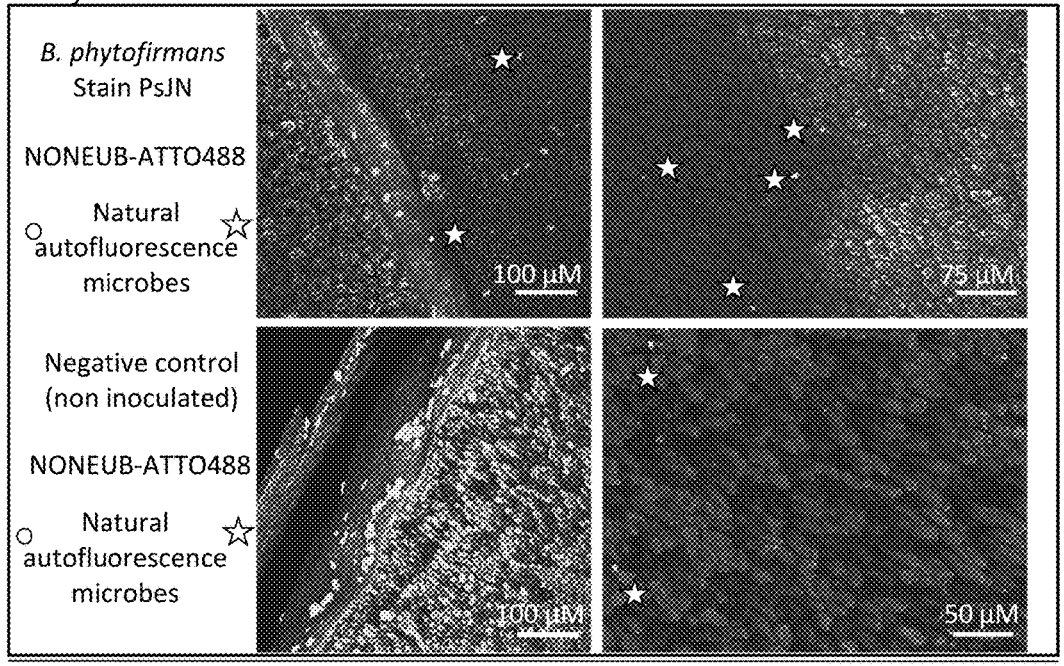

*sprayed with B. phytofirmans PsJN in field or greenhouse
sprayed simultaneously with B. phytofirmans PsJN and Paenibacillus sp. S10 in field or greenhouse Detection of PsJN in Soy Plant Tissues (Seeds) Using FISH Yellow fluorescent bacteria PsJN were found inside the embryo of soy PsJN-endoseed along with a very large amount of other unknown bacteria (green fluorescence), which also colonized the seed coat (FIG. 38A), while in control seeds only the native bacteria are present (green fluorescence). FIG. 38B shows that by using NONEUB probe only a few native autofluorescent microbes can be detected inside the embryo of seeds colonized by PsJN and in control seeds.

Conclusions for Example 9

*Burkholderia phytofirmans* PsJN can be introduced into seeds of winter wheat, summer wheat, barley and soy seeds by spraying cells onto flowers of parent plants. *B. phytofirmans* PsJN can be introduced into seeds of monocotyledons (as shown in this example for wheat and barley) as well as dicotyledons (as shown in this example for soy). PsJN colonizes soy seeds and is located within the embryo of soy seeds. *B. phytofirmans* PsJN can be introduced into seeds together with another bacterium upon spraying flowers of parent plants. Formulations containing zeolite and Silwet L-77 as a carrier and surfactant, respectively, produced high colonization in most of the endoseeds.

Example 10: Analysis of Microbial Communities of Endoseed Prepared in the Field

To determine the presence and abundance of the endophyte with which endoseed was prepared, DNA was extracted from the endoseed and was used to amplify 16S rDNA using the following method.

Experiment A: Illumina Sequencing on Germinated Endoseeds

Experimental Description

Endoseeds were prepared as in Example 9. 16S rDNA amplicon sequencing (MiSeq, Illumina) was performed on the following samples: 1. summer wheat Trappe control, 2. summer wheat Trappe PsJN, 3. summer wheat Trappe PsJN+S10, 4. summer wheat Trappe 510, 5. summer wheat Trappe TC38, 6. summer wheat Trappe AB, 7. summer wheat Kronjet control, 8. summer wheat Kronjet PsJN, 9. summer wheat Kronjet PsJN+S 10, 10. summer wheat Kronjet S10, 11. summer wheat Kronjet TC38, 12. summer wheat Kronjet AB, 13. barley Calcule control, 14. barley Calcule PsJN, 15. barley Calcule PsJN+S10, 16. barley Calcule S10, 17. barley Calcule TC38, 18. barley Calcule AB, 19. barley Eunova control, 20. barley Eunova PsJN, 21. barley Eunova PsJN+S10, 22. barley Eunova S10, 23. barley EunovaTC38, 24. barley Eunova AB.

Genomic DNA was isolated based on FastDNA® SPIN Kit for soil as described above and all gDNA were adjusted to 5 ng/µl. A nested PCR approach was used to amplify bacterial 16S rDNA from DNA isolated of wheat and barley seeds. The first amplification was performed with primers 799 for and 1392rev (Chelius and Triplett, 2001) with standard reaction parameters.

Twenty-five µl of the 16S rDNA PCR amplicons were subjected to electrophoresis (100V for 1 h) in 2% (w/v) TBE agarose gels (Biozym Biotech Trading, Vienna, Austria). Amplification with the primer pair 799F and 1392R allows exclusion of the amplification of chloroplast 16S rDNA and results in co-amplification of bacterial and mitochondrial ribosomal genes with the mitochondrial amplicon being about 1000 bp long whereas the bacterial band is about 600 bp. The band of interest containing the PCR-product of bacterial 16S rDNA was excised. The gel pieces were put in a filter tip that was placed in a fresh tube and DNA was collected by centrifugation for 2 min at 1000 rpm. The eluate was collected.

The second amplification was performed with the primers 799 for_illumina and 1175 R1_illumina, harboring the primer binding site for the Illumina indexing primers at the 5'-end using standard amplification reaction procedures as known in the art.

Twenty-five µl of the 16S rDNA PCR amplicons were subjected to electrophoresis (100V for 1 h) in 2% (w/v) TBE agarose gels (Biozym Biotech Trading, Vienna, Austria). The 500 bp bands were cut and gel pieces were put in a filter tip that was placed in a fresh tube and DNA was collected by centrifugation for 2 min at 1000 rpm. The eluate was collected.

Index PCR was performed with Nextera XT Index Kit (24 indices, 96 samples) (Illumina Inc., San Diego, USA) according to the manufacturers protocol.

In order to purify the amplicon away from free nucleotides and primers and primer dimer species before quantification we used AMPure XP beads following the manufacturer's protocol strictly.

Amplicon concentration has been measured using a Nanodrop and about 10 ng per sample were pooled. DNA quality and quantity of the pooled library was tested with an Agilent 2100 Bioanalyzer. The final amplicon size was about 570 bp including the adapter, sequencing primer binding site and index on both sides.

The library denaturing, addition of internal control DNA (PhiX, Illumina) and sample loading were done according to the Illumina protocol.

16S rDNA sequences processing was done as follows: The raw reads were screened for PhiX contamination using Bowtie2 (B. Langmead et al. (2012), Nat. Methods. vol. 9, no. 4, 357-359.) and data quality was checked in FASTQC (http://www.bioinformatics.babraham.ac.uk/projects/fastqc/). Overlapping reads were merged with PEAR (J. Zhang et al. (2014) *Bioinformatics*, vol. 30, no. 5, pp. 614-620, March 2014. and then labeled and pooled in QIIME (J. G. Caporaso et al. (2010) *Nat. Methods*, vol. 7, no. 5, pp. 335-336). Sequences were de-replicated, sorted and noisy filtered in vsearch (https://github.com/torognes/vsearch). Chimeras were removed using both a de novo and a reference based approach with UCHIME (R. C. Edgar et al. (2011) *Bioinforma. Oxf. Engl.*, vol. 27, no. 16, pp. 2194-2200). The ChimeraSlayer's database was used as a gold standard for the reference based chimera checking (B. J. Haas et al. (2011) *Genome Res.*, vol. 21, no. 3, pp.

494-504). OTU picking was accomplished in vsearch with the pairwise identity percentage of 0.97 and cluster centroid sequences aligned against the whole read pool using a full dynamic programming algorithm (Needleman-Wunsch) for global sequence alignment (T. Rogne, et al. (2011) *BMC Bioinformatics*, vol. 12, no. 1, p. 221). Taxonomy assignment was performed employing the naïve Bayesian RDP classifier with a minimum confidence of 0.8 (Q. Wang et al. (2007) *Appl. Environ. Microbiol.*, vol. 73, no. 16, pp. 5261-5267) against the last version of the Greengenes database (Aug. 2013) (D. McDonald et al. (2012) *ISME J.*, vol. 6, no. 3, pp. 610-618).

Overall shifts in bacterial community composition were assessed using non-metric multidimensional scaling and permutational multivariate analysis of variance. These analyses were based on a Bray-Curtis dissimilarities calculated from square-root transformed OTU observation counts. To compensate for differences in the number of sequences per sample, 1000 sequences were randomly taken from each sample to use in these analyses. Prior to analysis, OTUs without phylum level classifications were removed as an additional quality control measure.

To assess shifts in the relative abundances of individual taxa, mean relative abundances were calculated for each wheat cultivar and each treatment or control samples. These relative abundances were compared using a mixed effects model applied to each taxon in an automated R script (R Core Team 2013). For this model, cultivar was treated as a random effect while the treatment was treated as a fixed effect. Relative abundances were rank transformed prior to fitting the models. The models were calculated using the 'nlme' package in R. To control for potentially spurious OTUs, only OTUs represented by at least 1 sequence (i.e. 0.1% of the sequences), on average, were included in the analysis.

In addition, changes in the relative abundances of OTUs representing the strains used in the Endoseed treatments were assessed. This analysis was conducted by identifying these OTUs which were classified to the same genus as the strains used in the experimental treatments. The relative abundance of these OTUs were compared across controls and treatments.

Experimental Results Experiment S

Figure 39:
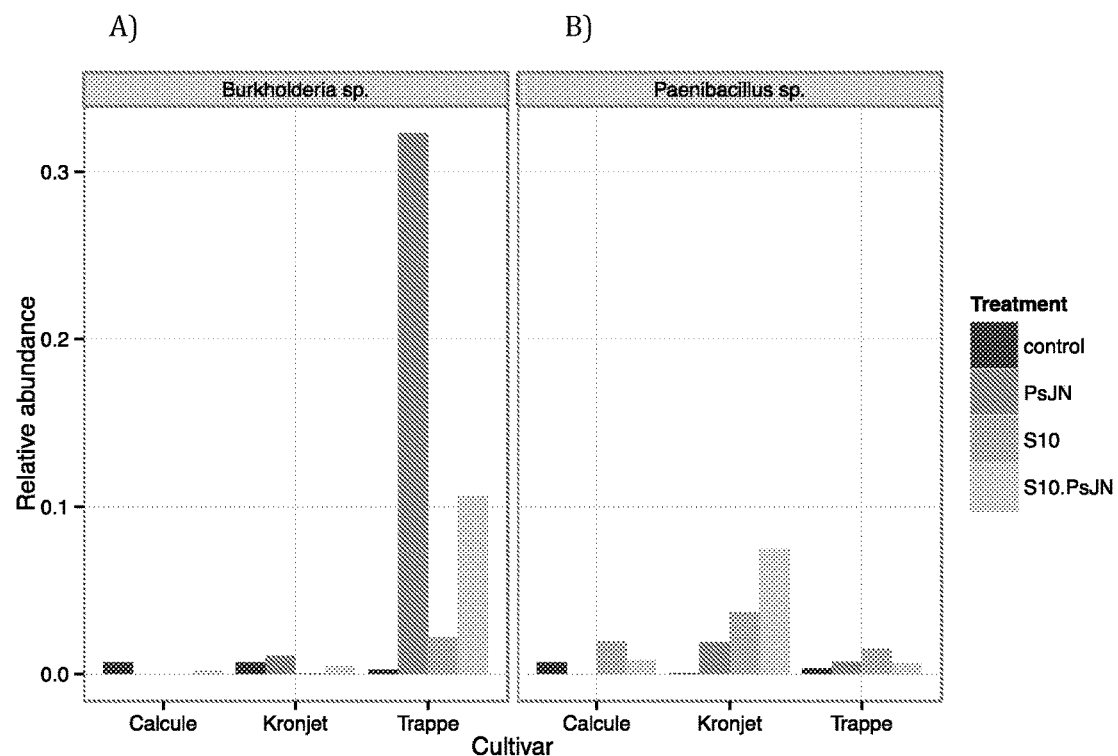
FIG. 39 shows the relative abundance of the PsJN (*Purkholderia* sp) and S10 (*Paenibacillus* sp.) in endoseeds treated with these endophytes, in summer wheat (*Triticum aestivum* cvs. Trappe and Kronjet) and barley (*Hordeum vulgare* cv. Calcule).
Figure 40:
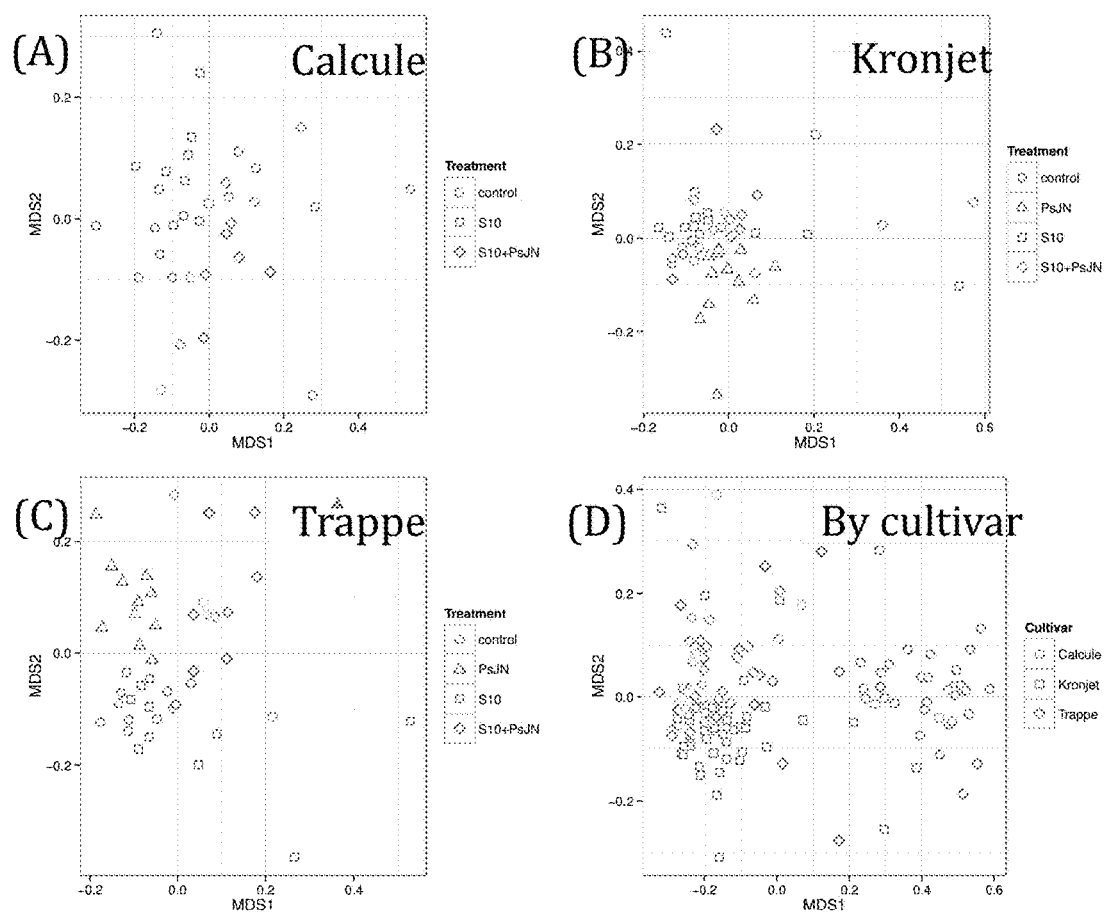
FIG. 40 shows a shift in the bacterial communities in endoseed treated with PsJN, S10, PsJN+S10 in the Kronjet (B) and Trappe (C) summer wheat varieties, but not in the Calcule (A) barley variety. Panel (D) shows that distinct bacterial communities live within seeds of the four varieties tested.

Deep amplicon sequencing of partial 16S rDNA of single endoseeds allowed identification of DNA of strain PsJN and S10 in summer wheat and barley seeds (FIG. 39). FIG. 40 shows that in the Kronjet and Trappe summer wheat varieties, the PsJN, S10, and PsJN+S10 treatments led to a shift in the bacterial communities in the endoseeds. Panel (D) shows that distinct bacterial communities live within seeds of the four varieties tested, as expected.

Looking at the level of the individual taxa, these sequencing indicated that, apart from taxa belonging to the *Paenibacillus* and the Burkholderiaceae families, there were shifts in other families of bacteria. The following bacteria appeared following treatment with endophytes: Kineosporiaceae, Weeksellaceae, Geodermatophilaceae, Bacillaceae, Thermicanus, Weeksellaceae, Geodermatophilaceae. The Chitinophagaceae and Alcaligenaceae families disappeared. A number of families were less abundant in endoseeds: Actinomycetaceae, Chitinophagaceae, Phyllobacteriaceae, Microbacteriaceae, Exiguobacteraceae, Sphingomonadaceae, Phyllobacteriaceae. The abundance of the Comamonadaceae and Xanthomonadaceae families increased with endoseed treatment.

Conclusion Experiment A

Bacterial strains of different phylogenetic background and ecological origin could be introduced into seeds of summer wheat and barley by spraying bacterial formulations on flowers of parent plants. Endoseed of summer wheat and barley carrying both, gram-positive (*Paenibacillus* sp. S10) and gram-negative (*B. phyotfirmans* PsJN, *Flavobacteium* sp, TC38) bacteria could be generated.

Experiment B: Sanger Sequencing on Germinated Endoseeds

Experimental Description

The following endoseeds were used for this experiment: soy (Essor and Merlin) treated with sterile broth, PsJN or NC92, summer wheat (Kronjet and Trappe) treated with sterile broth, PsJN, S10, PsJN+S10 or *Aneurinibacillus* sp, AB and winter wheat (Pannonikus) treated with sterile broth or PsJN. Twenty seeds for each of these endoseed treatments and their corresponding controls were surface sterilized using chlorine gas, except for soybean, where only 6 seeds were used. All surface sterilized seeds were germinated on water agar plates in the dark at room temperature. As soon as they germinated, 5 healthy seedlings per treatment (2 for soybean) were transferred into an empty, sterile water agar filled glass jar and incubated at 25 C for 7 days. Using sterile forceps, intact seedlings were pulled out of the jars and placed (roots and shoots together) into a clean 50 mL conical tube. 3 mL of sterile water and 3 carbide beads were added per tube, and the tube was agitated at 6 M vibrations/sec for 60 seconds in a Fastprep machine. 150 uL of the resulting slurry was transferred into an Eppendorf tube for extraction using a MoBio PowerPlant® Pro-htp 96 Well DNA Isolation Kit. Bacterial populations were studied through amplication of the V5, 6, 7 and 8 regions of the 16S rRNA gene using the chloroplast excluding primer 799F and 1492R. Amplicons were run on a 1% agarose gel and 700 bp fragments cut out to separate them from mitochondrial bands. These bacterial 16S bands were put into TOPO TA cloning vectors, transformed into *E. coli* and the resulting libraries sequenced by Genewiz (Cambridge, Mass.). Genewiz randomly picked 50 clones per rep, amplified them by rolling circle amplification, then conducted Sanger sequencing using T3 primers. Sequences were processed and annotated in batches by Geneious™ software (Biomatters Limited, Auckland, New Zealand).

Results Experiment B

Figure 41:
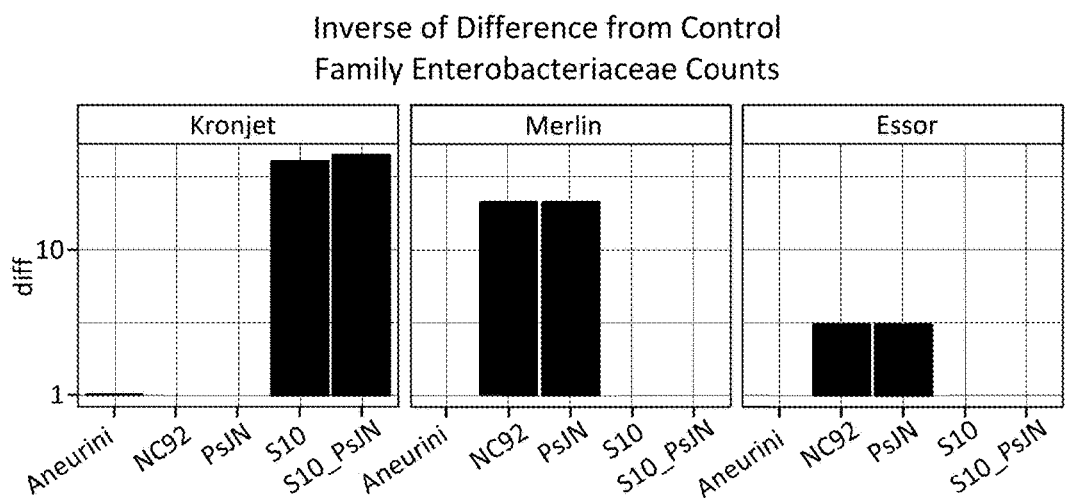
FIG. 41 shows a decrease of bacteria of the *Enterobacter* family within synthetic combinations of the plants and bacterial endophytes. In summer wheat (Kronjet), treatment with S10 and S10+PsJN, resulted in a decrease of bacteria of the *Enterobacter* family. Treatment of the Essor and Merlin soy varieties with NC92 and PsJN similarly caused a decrease of bacteria of the *Enterobacter* family.

From this experiment, the *Enterobacter* family was the only family of bacteria that showed sufficient counts from the Sanger sequencing to be able to do a reliable analysis, and this only in the Kronjet summer wheat variety and the Essor and Merlin soy varieties. In summer wheat (Kronjet), treatment with S10 and S10+PsJN, resulted in a decrease of bacteria of the *Enterobacter* family within the synthetic combinations of the wheat plants and bacterial endophytes (FIG. 41). Note that FIG. 41 shows the inverse of the difference, meaning that a decrease is represented as a positive bar. In both soy varieties, treatment with NC92 and PsJN caused a decrease of bacteria of the *Enterobacter* family.

Conclusion for Example 10

The generation of seeds containing endophytes resulted in a decrease of bacteria of the *Enterobacter* family within the synthetic combinations of the plants and bacterial endophytes.

Example 11: Proteomic Analysis

In order to explore the pathways augmented or otherwise modified by the bacteria in the endoseeds, we performed proteomic analysis on extracts of wheat, maize and soy plants grown from endoseeds.

Experimental Description

Endoseeds were prepared as in Example 9, and the following samples were used for proteomic measurements (Table T).

TABLE T

Samples used for proteomic measurements.

| Sample # | Crop | Cultivar | Treatment |
|---|---|---|---|
| 1 | Winter wheat | Pannonikus | untreated |
| 2 | Winter wheat | Pannonikus | mock |
| 3 | Winter wheat | Pannonikus | PsJN |
| 4 | Summer wheat | Trappe | untreated |
| 5 | Summer wheat | Trappe | mock |
| 6 | Summer wheat | Trappe | S10 |
| 7 | Summer wheat | Trappe | PsJN |
| 8 | Summer wheat | Kronjet | untreated |
| 9 | Summer wheat | Kronjet | mock |
| 10 | Summer wheat | Kronjet | PsJN |
| 11 | Summer wheat | Kronjet | *Aneurinibacillus* sp. |

After 7 days of growth on water agar, 12 whole seedlings (including roots, seeds and hypocotyls) per treatment were collected in a 50 mL falcon tube using sterile forceps and immediately snap-frozen in liquid nitrogen to minimize protein degradation and proteomic changes during sample collection (such as wound responses from using the forceps). The frozen samples were then homogenized using a pestle and mortar previously cooled in liquid nitrogen and transferred to a 15 mL falcon tube on dry ice. The homogenized samples were stored at −80° C. until further processing.

1 mL of 5% SDS 1 mM DTT was added to 1 mL of homogenized tissue and the samples were boiled for 5 m. The samples were cooled on ice and 2 mL of 8M urea solution was added. The samples were spun for 20 m at 14,000 rpm and the soluble phase recovered. A 25% volume of 100% TCA solution was added to the soluble phase, left on ice for 20 m and centrifuged for 10 m at 14,000 rpm. The protein pellet was washed twice with ice-cold acetone and solubilized in 125 µL 0.2M NaOH and neutralized with 125 µL of 1M Tris-Cl pH 8.0. Protein solutions were diluted in THE (50 mM Tris-Cl pH8.0, 100 mM NaCl, 1 mM EDTA) buffer. RapiGest SF reagent (Waters Corp., Milford, Mass.) was added to the mix to a final concentration of 0.1% and samples were boiled for 5 min. TCEP (Tris (2-carboxyethyl) phosphine) was added to 1 mM (final concentration) and the samples were incubated at 37° C. for 30 min. Subsequently, the samples were carboxymethylated with 0.5 mg ml$^{-1}$ of iodoacetamide for 30 min at 37° C. followed by neutralization with 2 mM TCEP (final concentration). Proteins samples prepared as above were digested with trypsin (trypsin:protein ratio of 1:50) overnight at 37° C. RapiGest was degraded and removed by treating the samples with 250 mM HCl at 37° C. for 1 h followed by centrifugation at 14,000 rpm for 30 min at 4° C. The soluble fraction was then added to a new tube and the peptides were extracted and desalted using Aspire RP30 desalting columns (Thermo Scientific). The trypsinized samples were labeled with isobaric tags (iTRAQ, ABSCIEX, Ross et al 2004), where each sample was labeled with a specific tag to its peptides.

Each set of experiments (samples 1-6; 7, 8; 9-12; 13-16; 17-20) was then pooled and fractionated using high pH reverse phase chromatography (HPRP-Xterra C18 reverse phase, 4.6 mm×10 mm 5 µm particle (Waters)). The chromatography conditions were as follows: the column was heated to 37° C. and a linear gradient from 5-35% B (Buffer A-20 mM ammonium formate pH10 aqueous, Buffer B-20 mM ammonium formate pH10 in 80% ACN-water) was applied for 80 min at 0.5 ml min$^{-1}$ flow rate. A total of 30 fractions of 0.5 ml volume where collected for LC-MS/MS analysis. Each of these fractions was analyzed by high-pressure liquid chromatography (HPLC) coupled with tandem mass spectroscopy (LC-MS/MS) using nano-spray ionization. The nanospray ionization experiments were performed using a TripleTOF 5600 hybrid mass spectrometer (AB SCIEX Concord, Ontario, Canada)) interfaced with nano-scale reversed-phase HPLC (Tempo, Applied Biosystems (Life Technologies), CA, USA) using a 10 cm-180 micron ID glass capillary packed with 5 µm C18 Zorbax™ beads (Agilent Technologies, Santa Clara, Calif.). Peptides were eluted from the C18 column into the mass spectrometer using a linear gradient (5-30%) of ACN (Acetonitrile) at a flow rate of 550 µl min$^{-1}$ for 100 min. The buffers used to create the ACN gradient were: Buffer A (98% H$_2$O, 2% ACN, 0.2% formic acid, and 0.005% TFA) and Buffer B (100% ACN, 0.2% formic acid, and 0.005% TFA). MS/MS data were acquired in a data-dependent manner in which the MS1 data was acquired for 250 ms at m/z of 400 to 1250 Da and the MS/MS data was acquired from m/z of 50 to 2,000 Da. For Independent data acquisition (IDA) parameters MS1-TOF 250 ms, followed by 50 MS2 events of 25 ms each. The IDA criteria, over 200 counts threshold, charge state +2-4 with 4 s exclusion. Finally, the collected data were analyzed using Protein Pilot 4.0 (AB SCIEX) for peptide identifications and quantification.

Experimental Results

Synthetic combinations of wheat plants and bacterial endophytes (PsJN, *Aneurinibacillus* sp. and S10) grown under normal conditions produce a proteomic signature including polypeptides associated with growth promotion, resistance against stress and mechanisms involved in symbiosis enhancement (Tables U, V, and W).

Proteins directly involved in growth promotion, e. g. elongation factors, proteins related to nutrient acquisition (succinyl-CoA ligase) and proteins involved in chromosomal segregation during mitosis (hypothetical protein TRIUR3_30538), are increased in treated plants relative to control plants.

Proteins with demonstrated effects in plant defense or tolerance against abiotic stresses are modulated. For example, proteins involved in response to heavy metals, e.g. adenosylhomocysteinase and 60S ribosomal protein L19-2, increased and decreased, respectively, relative to control plants. It is important to note that a S10, used in some of the treatments here, was positive in resistance to all of the heavy metals with which it was tested (Table H, Example 5). Proteins associated with ion transport and salt stress tolerance, e.g. V-type proton ATPase catalytic subunit A and 26S proteasome non-ATPase regulatory subunit RPN12A are increased in treated plants relative to controls, whereas a putative calcium-binding protein CML7 is decreased. Proteins associated to water stress, both in the form of flooding and desiccation, e.g. the T-complex protein 1 subunit beta and a putative phospholipase D alpha 1 precursor, are increased in treated plants relative to controls.

A number of proteins involved in the establishment of symbiosis with beneficial microbes and/or defense against pathogenic microbes is altered in treated plants in relation to control plants. Proteins involved in defense against pathogenic microbes, for example Luminal-binding protein 3, Stromal 70 kDa heat shock-related protein (chloroplastic)

and 5-methyltetrahydropteroyltriglutamate-homocysteine methyltransferase, are increased relative to controls.

The ribosomal proteins, 60S ribosomal protein L14-1, 60S ribosomal protein L18-2, 40S ribosomal protein S15a-1, 40S ribosomal protein S4, 60S ribosomal protein L8, 40S ribosomal protein S11, 60S ribosomal protein L10-2 had altered levels of expression in the treated plants in compared to control plants. The regulation of some ribosomal proteins was observed previously in response to *Burkholderia phytofirmans* (PsJN)[Hubalek, Valerie (2009) Diplomarbeit, Universität Wien. Fakultät für Lebenswissenschaften, incorporated herein by reference in its entirety].

Calreticulin, a putative lipoxygenase 3 and Glyceraldehyde-3-phosphate dehydrogenase, cytosolic 3, which are homologous to proteins involved in nodule formation in legumes, are increased in treated wheat plants relative to control wheat plants. Many genes involved in nodulation, such as nodulation receptor kinases, are broadly distributed in the plant kingdom, even in plants incapable of forming nodules, as in the case of wheat [Endre et al. (2002) Nature 417:962-966, incorporated herein by reference in its entirety]. Some of these conserved receptors may sense bacterial signals in symbiotic associations other than legume-*rhizobia* and this may explain why the nodulation factors from *Badyrhizobium japonicum* are able to enhance seed germination and root growth in plants such as corn [Suleimanov et al. (2002) J. Exp. Bot. 53:1929-1934, incorporated herein by reference in its entirety].

Proteins associated with micorrhiza also had altered expression levels in treated plants relative to controls. In particular, elongation factor 1-alpha and ATP synthase subunit alpha, mitochondrial are increased. Two ribosomal proteins, 40S ribosomal protein S4 and 40S ribosomal protein S11, were decreased in treated plants relative to controls. Frettinger et al. (2007) hypothesized that when the plant is in symbiosis with an endophyte, it will slow down its maintenance processes to become more efficient, thereby compensating for the cost of feeding the microbial symbiont.

TABLE U

Proteins involved in growth promotion showing differential levels of expression in winter and summer wheat germinated seeds relative to not-inoculated control germinated seeds.

| | Growth Promotion | | Treatment | | |
|---|---|---|---|---|---|
| Accession number | Gene name | Function | PsJN | *Aneurinibacillus* sp. | S10 |
| gi\|473753353 | 40S ribosomal protein S19 | Developmental regulation in endosperm | + | | |
| gi\|473882607 | Hypothetical protein TRIUR3_30538 | Similar to bacterial chromosome segregation | | + | |
| gi\|474259811 | Elongation factor 1-gamma 2 | Upregulated in cotyledons during development | | | + |

+, upregulated compared to control;
−, downregulated compared to control

TABLE V

Proteins involved in resistance against abiotic stress showing differential levels of expression in winter and summer wheat germinated seeds relative to not-inoculated control germinated seeds.

| | Resistance Against Abiotic Stress | | Treatment | | |
|---|---|---|---|---|---|
| Accession number | Gene name | Function | PsJN | *Aneurinibacillus* sp. | S10 |
| gi\|473886243 | 60S ribosomal protein L26-1 | Upregulated in soy under flooding stress | | | + |
| gi\|473890451 | T-complex protein 1 subunit beta | Upregulated in soy under flooding stress | | + | |
| gi\|473970552 | Heat shock 70 kDa protein, mitochondrial | Upregulated in wheat under nitrogen stress | | + | |
| gi\|474154141 | Adenosylhomocysteinase | Regulated in wheat in response to Hg exposure | + | | + |
| gi\|474188401 | Enolase | Upregulated in wheat in response to drought | | + | + |
| gi\|474302864 | Putative calcium-binding protein CML7 | Downregulated in ascorbate-primed wheat seeds during germination under salt stress | − | | |
| gi\|474431297 | V-type proton ATPase catalytic subunit A | Energy generation for transport of ions (salt and water stress response in barley colonized with *Piriformospora indica*) | | | + |
| gi\|474438538 | RuBisCO large subunit-binding protein subunit beta, chloroplastic | Upregulated in common bean in response to drought stress | | + | |
| gi\|209944123 | putative phospholipase D alpha 1 precursor | Mediated signal transduction/Upregulated in chinese cabbage under dessication stress | + | | |

TABLE V-continued

Proteins involved in resistance against abiotic stress showing differential levels of expression in winter and summer wheat germinated seeds relative to not-inoculated control germinated seeds.

| | Resistance Against Abiotic Stress | | Treatment | | |
|---|---|---|---|---|---|
| Accession number | Gene name | Function | PsJN | *Aneurinibacillus* sp. | S10 |
| gi\|473901576 | 60S ribosomal protein L19-2 | Regulated in wheat in response to Hg exposure | | | − |
| gi\|474135678 | 26S proteasome non-ATPase regulatory subunit RPN12A | Upregulated in seedling roots of salt tolerant soybean in responses to salinity stress | + | | |
| gi\|474416088 | Elongation factor 2 | Downregulation in *Medicago truncatula* under water deficit | + | | |

+, upregulated compared to control;
−, downregulated compared to control

TABLE W

Proteins involved in symbiosis defense or establishment showing differential levels of expression in winter and summer wheat germinated seeds relative to not-inoculated control germinated seeds.

| | Symbiosis Defense or Establishment | | Treatment | | |
|---|---|---|---|---|---|
| Accession number | Gene name | Function | PsJN | *Aneurinibacillus* sp. | S10 |
| gi\|1346344 | Keratin, type II cytoskeletal 6A | Infection structure development | | | + |
| gi\|473790174 | 60S ribosomal protein L14-1 | Response to *Burkholderia phytofirmans* | + | | |
| gi\|473742212 | 60S ribosomal protein L18-2 | Response to *Burkholderia phytofirmans* | | | − |
| gi\|474186081 | 40S ribosomal protein S15a-1 | Response to *Burkholderia phytofirmans* | + | | |
| gi\|473970549 | Aspartate aminotransferase, cytoplasmic | Response to bacterial ACC deaminase | | | + |
| gi\|474200923 | Luminal-binding protein 3 | Pathogen response in barley | + | | + |
| gi\|474247591 | ATP synthase subunit alpha, mitochondrial | Upregulated in symbiotically colonized orchid | + | | + |
| gi\|474250318 | Phosphoenolpyruvate carboxylase 2 | Upregulated in transgenic pest resistant oranges | + | | + |
| gi\|474258378 | Calreticulin | Upregulated in sweetclover symbiotic with *Sinorhizobium meliloti* | + | + | |
| gi\|474369382 | Nucleoside diphosphate kinase 1 | Upregulated in rice infected with bacteria | | | + |
| gi\|474384893 | Putative lipoxygenase 3 | Symbiotic nodule formation | + | | |
| gi\|474388024 | Elongation factor 1-alpha | Upregulated in cells harboring arbuscular mycorrhiza | + | | |
| gi\|474449989 | Glyceraldehyde-3-phosphate dehydrogenase, cytosolic 3 | Upregulated in cell walls in response to symbiotic elicitors | | | + |
| gi\|386848 | keratin | Regulated in cell walls during nodulation | − | − | + |
| gi\|473930078 | 40S ribosomal protein S4 | Regulated in response to mycorrhiza | − | | |
| gi\|473935893 | Actin-depolymerizing factor 4 | Similar to rice OslecRK, involved in immune response and seed germination | | | − |
| gi\|473939759 | Stromal 70 kDa heat shock-related protein, chloroplastic | Upregulated in tomato in response to a protective strain of *Fusarium oxysporum* | | | + |
| gi\|473970552 | Heat shock 70 kDa protein, mitochondrial | Upregulated in soybean root hairs after infection by *Bradyrhizobium japonicum* | + | | |
| gi\|473987280 | Aldehyde dehydrogenase family 2 member B7, mitochondrial | Upregulated in *Brassica napus* guard cells in response to methyl jasmonate | + | | − |
| gi\|473993048 | UTP-glucose-1-phosphate uridylyltransferase | Upregulated by salicylic acid treatment on sweet cherry fruits in the presence of pathogens | | | − |
| gi\|473993302 | 5-methyltetrahydropteroyltri-glutamate-homocysteine methyltransferase | Regulated in sugarcane in response to the endophytic plant-growth-promoting bacterium *Gluconacetobacter diazotrophicus* | | | + |

TABLE W-continued

Proteins involved in symbiosis defense or establishment showing differential levels of expression
in winter and summer wheat germinated seeds relative to not-inoculated control germinated seeds.

| | Symbiosis Defense or Establishment | | | Treatment | |
|---|---|---|---|---|---|
| Accession number | Gene name | Function | PsJN | *Aneurinibacillus* sp. | S10 |
| gi\|474040032 | Chaperonin CPN60-2, mitochondrial | Sulfenylated in *Medicago truncatula* during symbiosis with *Sinorhizobium meliloti* | − | | |
| gi\|474077243 | ADP, ATP carrier protein, mitochondrial | Upregulated in perennial ryegrass colonized with the endophytic fungus *Neotyphodium lolii* | | | + |
| gi\|474086745 | 60S ribosomal protein L8 | Downregulated in common bean roots symbiotic with compatible bacteria | | | − |
| gi\|474094006 | 1-Cys peroxiredoxin PER1 | Pathogenesis related protein; regulated during germination and seedling growth of chickpea under suboptimal soil-water conditions | − | | |
| gi\|474113969 | RuBisCO large subunit-binding protein subunit alpha, chloroplastic | Sulfenylated in *Medicago truncatula* during symbiosis with *Sinorhizobium meliloti* | + | | |
| gi\|474299793 | 40S ribosomal protein S11 | Downregulated in oak microcuttings inoculated with the ectomicorrhiza *Piloderma croceum* | − | | |
| gi\|474440867 | 60S ribosomal protein L10-2 | Upregulated in wheat leaves inoculated with pathogenic powdery mildew | − | | |

+, upregulated compared to control;
−, downregulated compared to control

Conclusion for Example 11

Proteins directly involved in growth promotion, e. g. elongation factors, proteins related to nutrient acquisition and proteins involved in chromosomal segregation during mitosis are increased in synthetic combinations of wheat plants and bacterial endophytes. Proteins with demonstrated effects in plant defense or tolerance against abiotic stresses, for example, proteins involved in response to heavy metals, proteins associated with ion transport and proteins involved in salt stress and water stress tolerance, were also modulated. In addition, proteins involved in the defense or establishment of symbiosis with microbes were regulated. For example, proteins involved in pathogen response, ribosomal proteins, proteins homologous to those involved in nodule formation in legumes, and proteins associated with micorrhiza were modulated.

Example 12: Germination Rate of Endoseeds Prepared in the Field

The ambition of this germination assay was to find out if there is a difference in germination and growth between endoseeds and non-treated seeds of summer wheat (*Triticum aestivum* cvs. Trappe and Kronjet) or barley (*Hordeum vulgare* cvs. Eunova and Calcule) inoculated with *Burkholderia phytofirmans* (PsJN), *Flavobacterium* sp. (TC38), *Paenibacillus tundrae* (S 10), a mixture of *Paenibacillus* sp. S10 and *Burkholderia phytofirmans* (S10+PsJN) or *Aneurinibacillus* sp. AB.

Experimental Description

Endoseeds were prepared as in Example 9. Seeds were put on filter paper strips, moistened with Milli-Q-water. Another moistened filter paper strip was put on top of it. Both stripes, with the seeds in-between, were rolled up. The rolls were put into an airtight plastic container for germination and to keep them moist. The rolls were opened up daily for regular rating of the state of germination and the germination rate was scored starting on day 1 until day 4, except the germination was rated only until day 3, as the germination was finished by then. The germination state was determined on a scale of 0 to 5 for wheat as follows: "0" is no germination; "1" corresponds to germination, first root tip visible; "2" corresponds to three little roots and a first little shoot visible; "3" corresponds to a light green shoot; "4" corresponds to a green shoot at least 1 cm in length; "5" corresponds to a green shoot at least 2 cm in length. For barley, germination state was determined on a scale of 0 to 7 as follows: "0" is no germination; "1" corresponds to germination, first root tip visible; "2" corresponds to two to three little roots and a first little shoot visible; "3" corresponds to a light green shoot; "4" corresponds to a green shoot at least 1 cm in length; "5" corresponds to a green shoot at least 2 cm in length; "6" corresponds to tip of leaf being visible; "7" corresponds to leaf being visible for at least 2 cm.

Apart from germination seedling growth was determined by measuring the length of the main root and the shoot with a ruler on day 4.

Experimental Results

Figure 42:
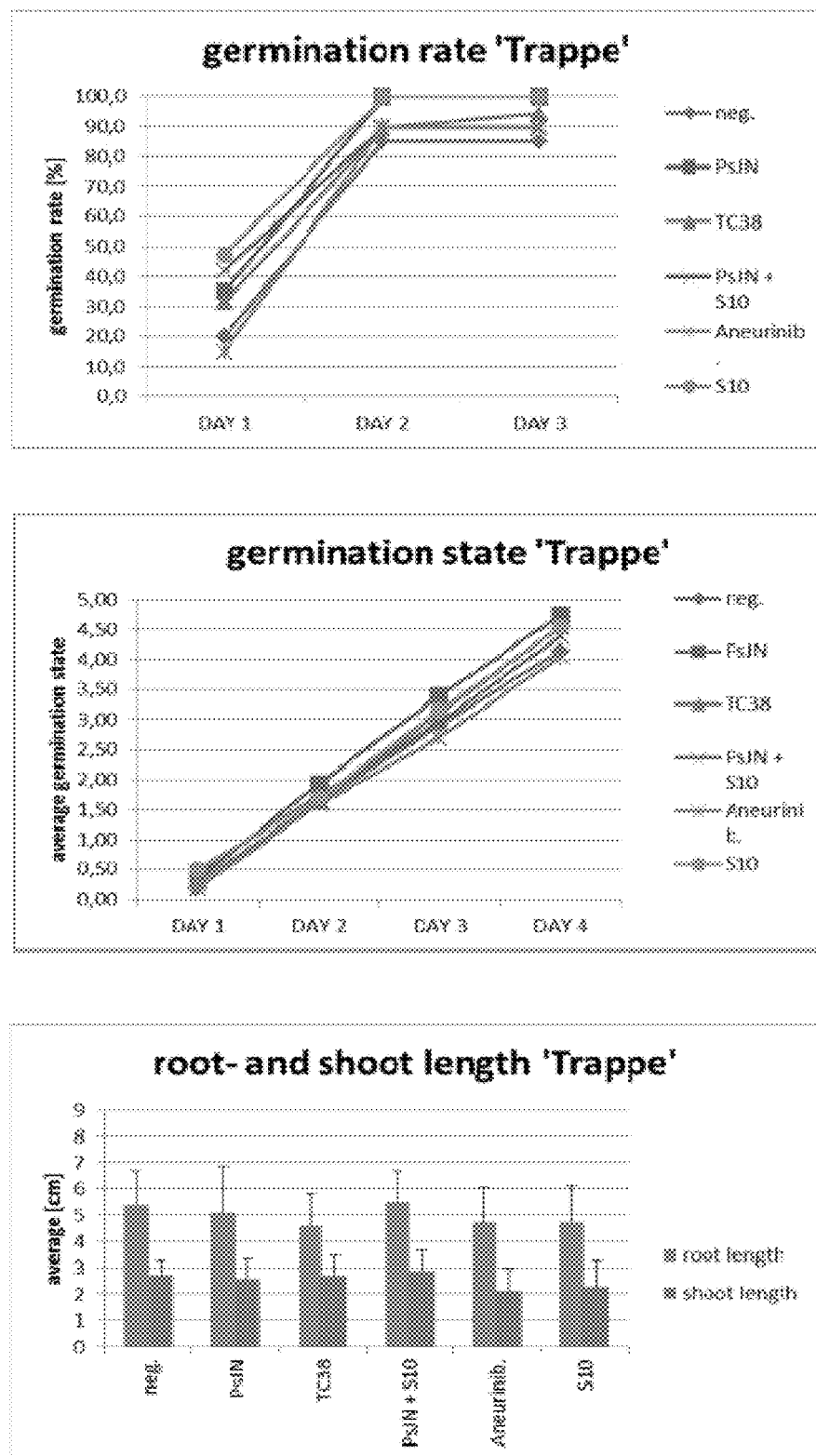
FIG. 42 shows the germination rate [% of seeds germinated], germination state and root- and shoot length of seedlings of endoseed and control seeds of summer wheat (*Triticum aestivum* cvs. Trappe and Kronjet) and barley (*Hordeum vulgare* cv. Eunova and Calcule) endoseeds colonized by endophytes from different origin and taxonomy.
Figure 42:
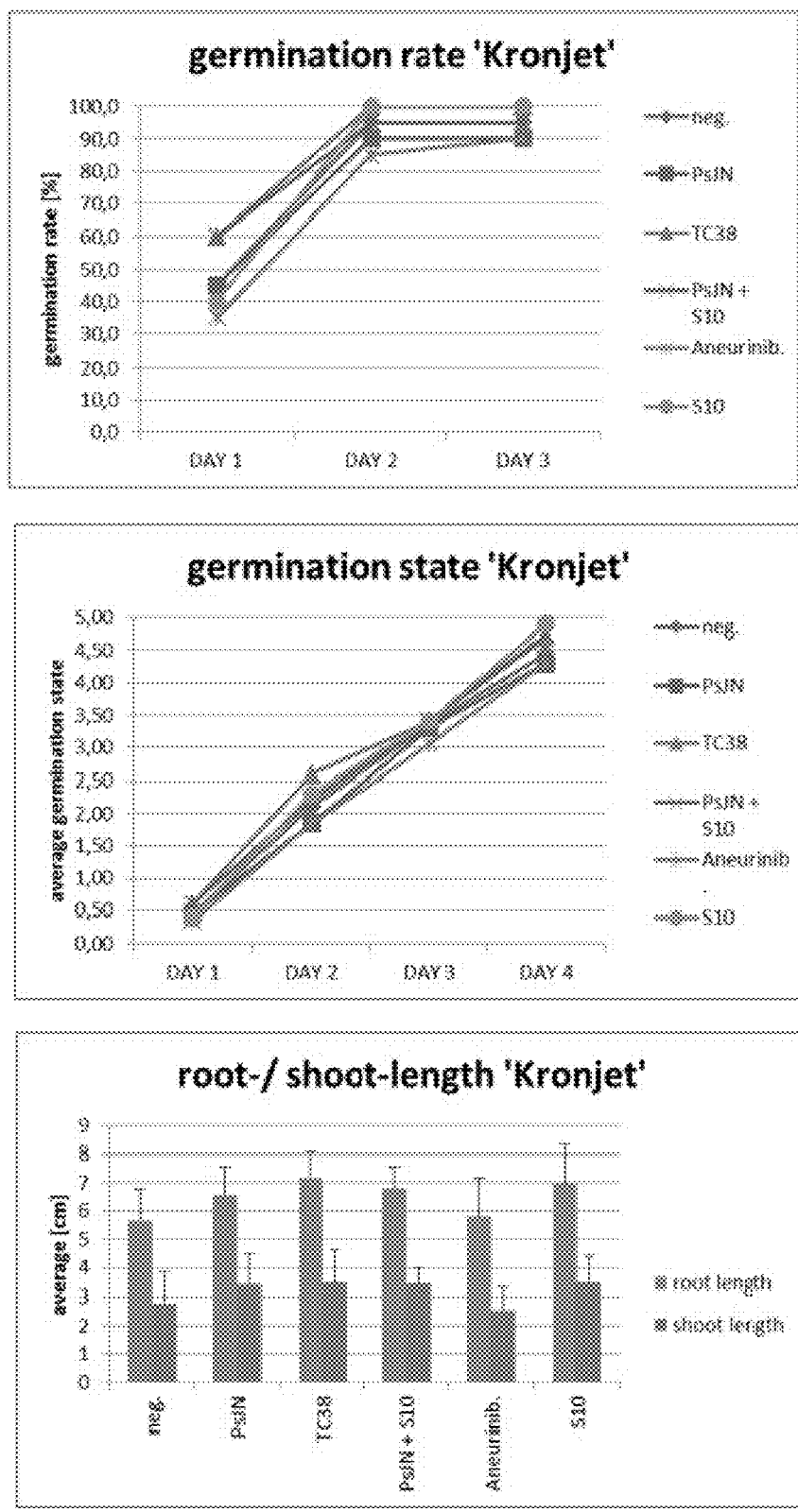
Figure 42:
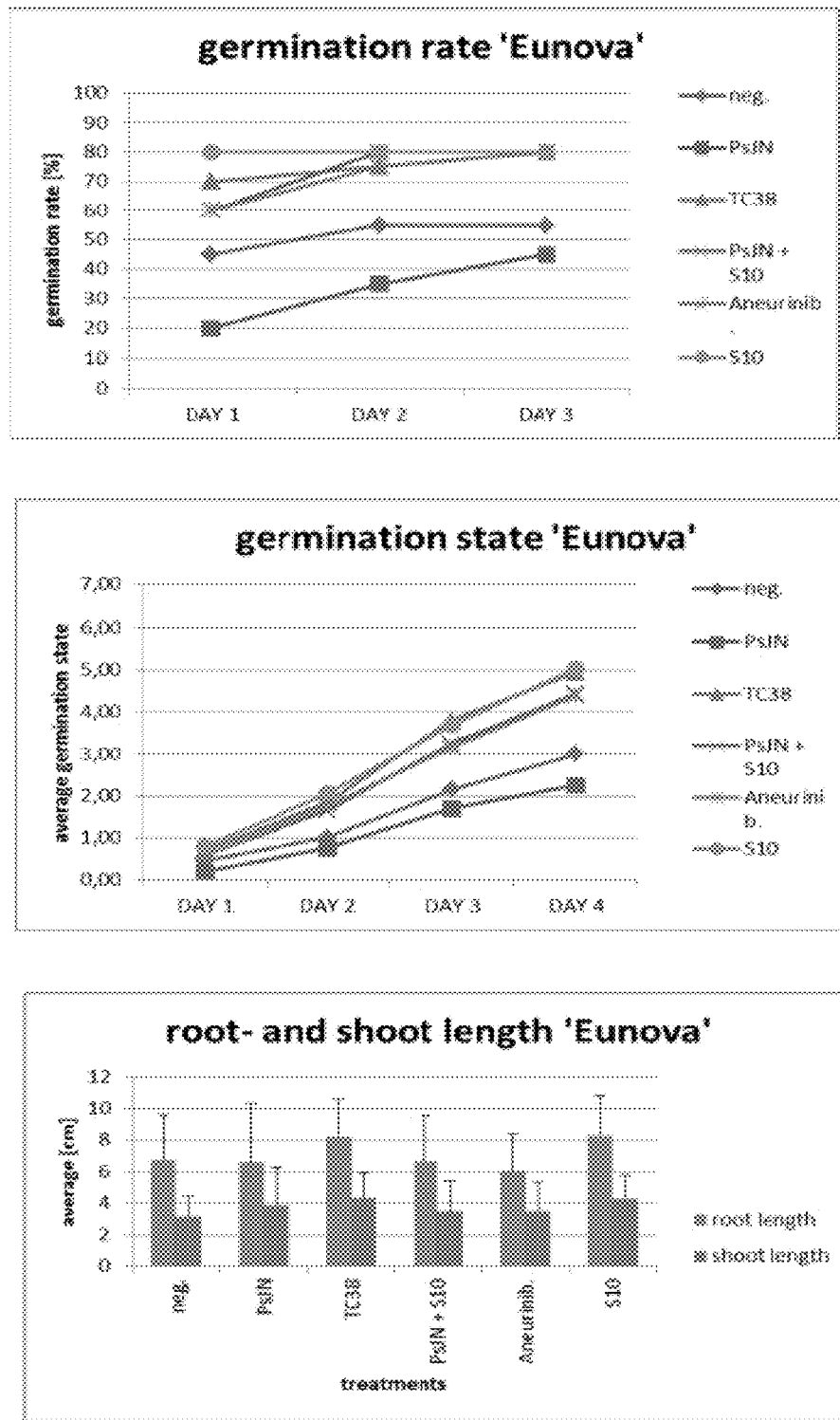
Figure 42:
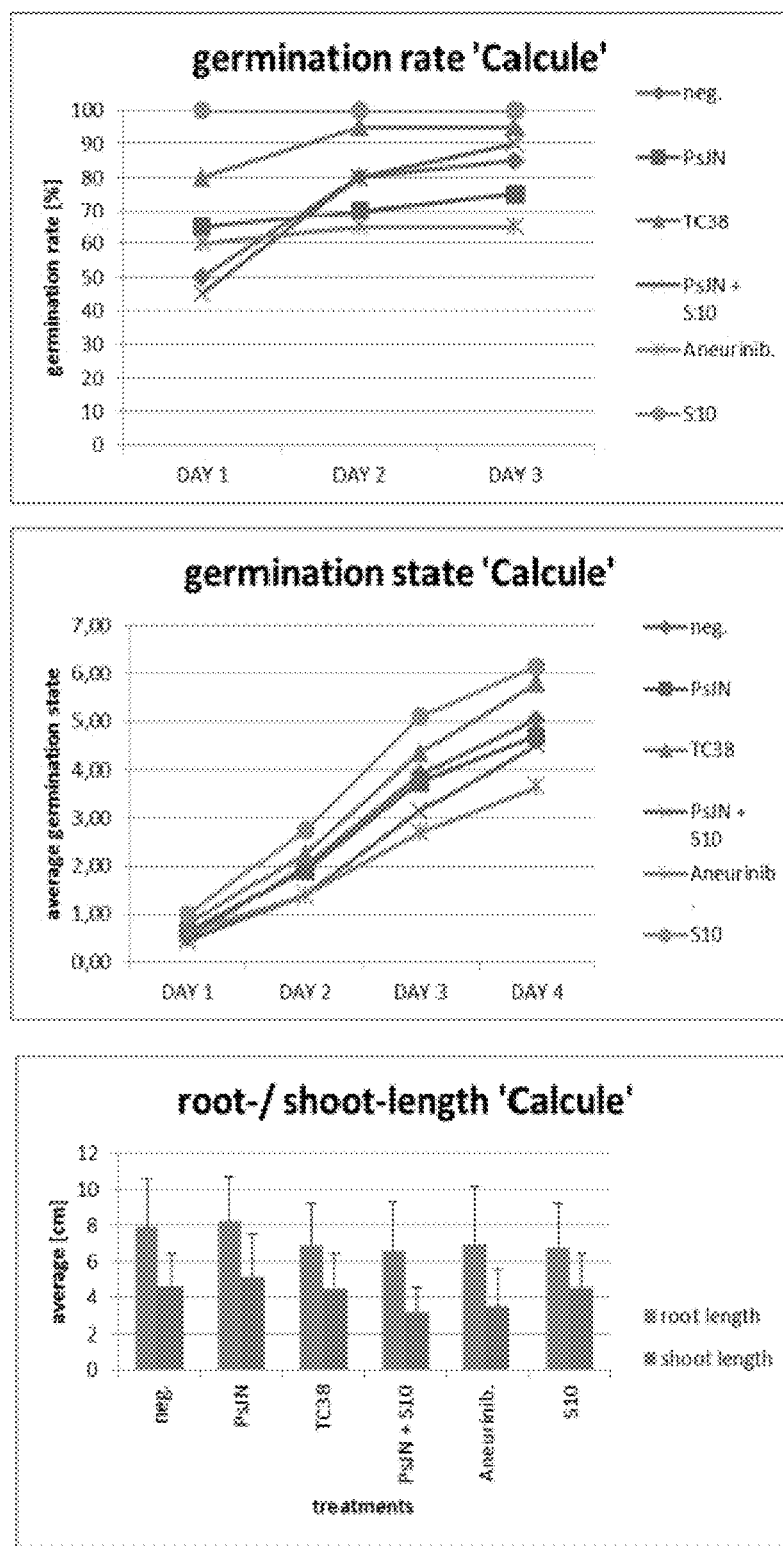
Figure 42:
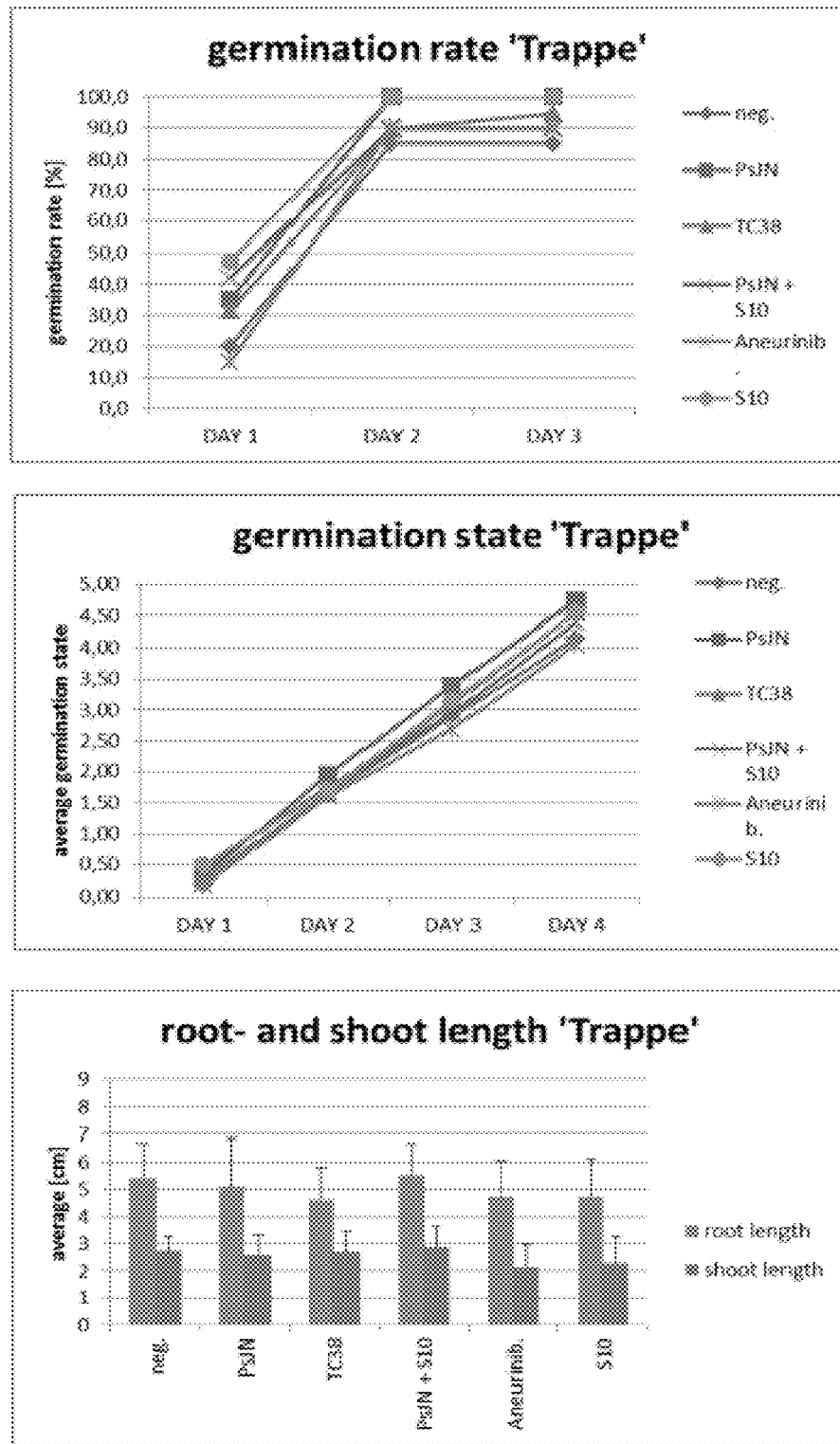
Figure 42:
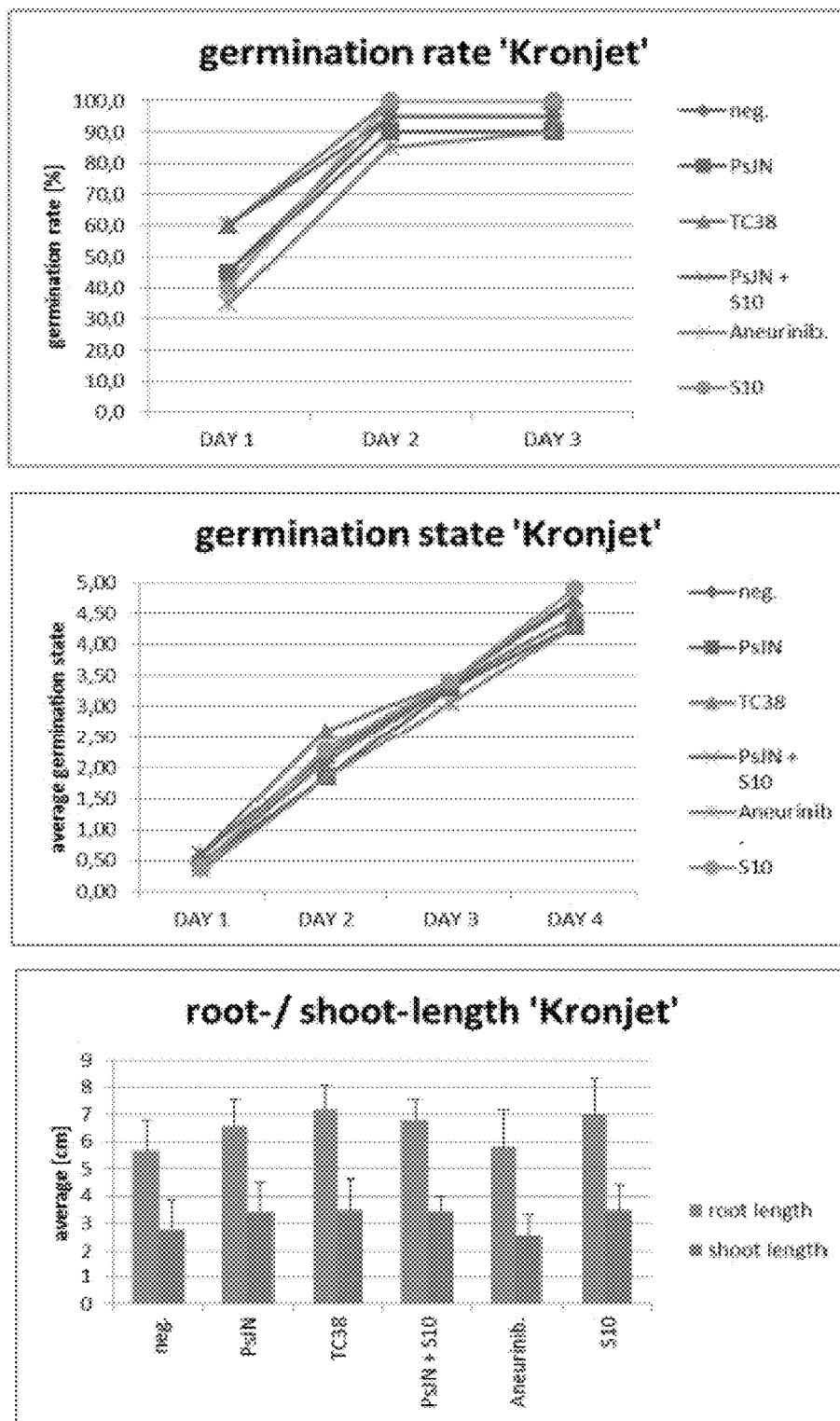
Figure 42:
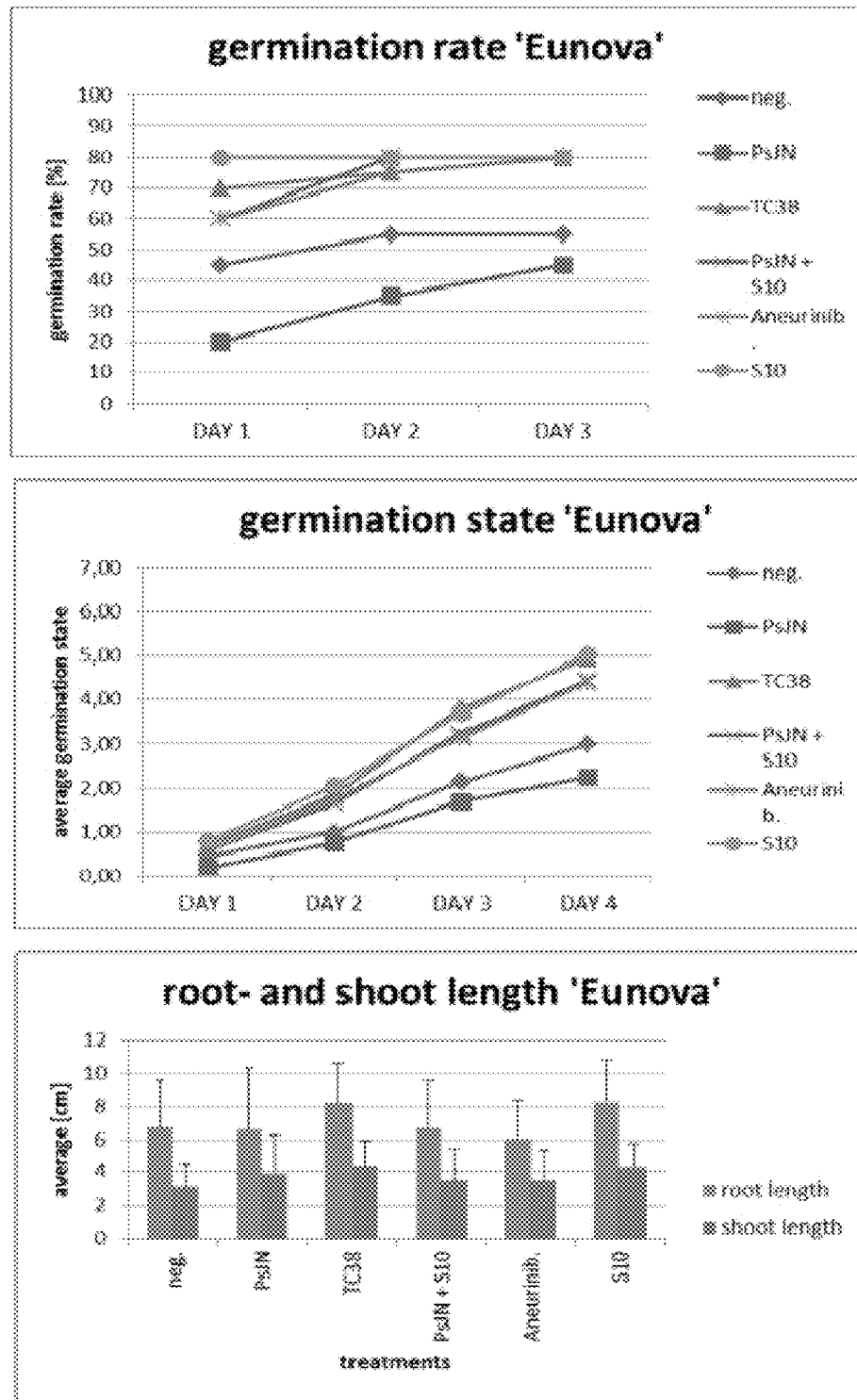
Figure 42:
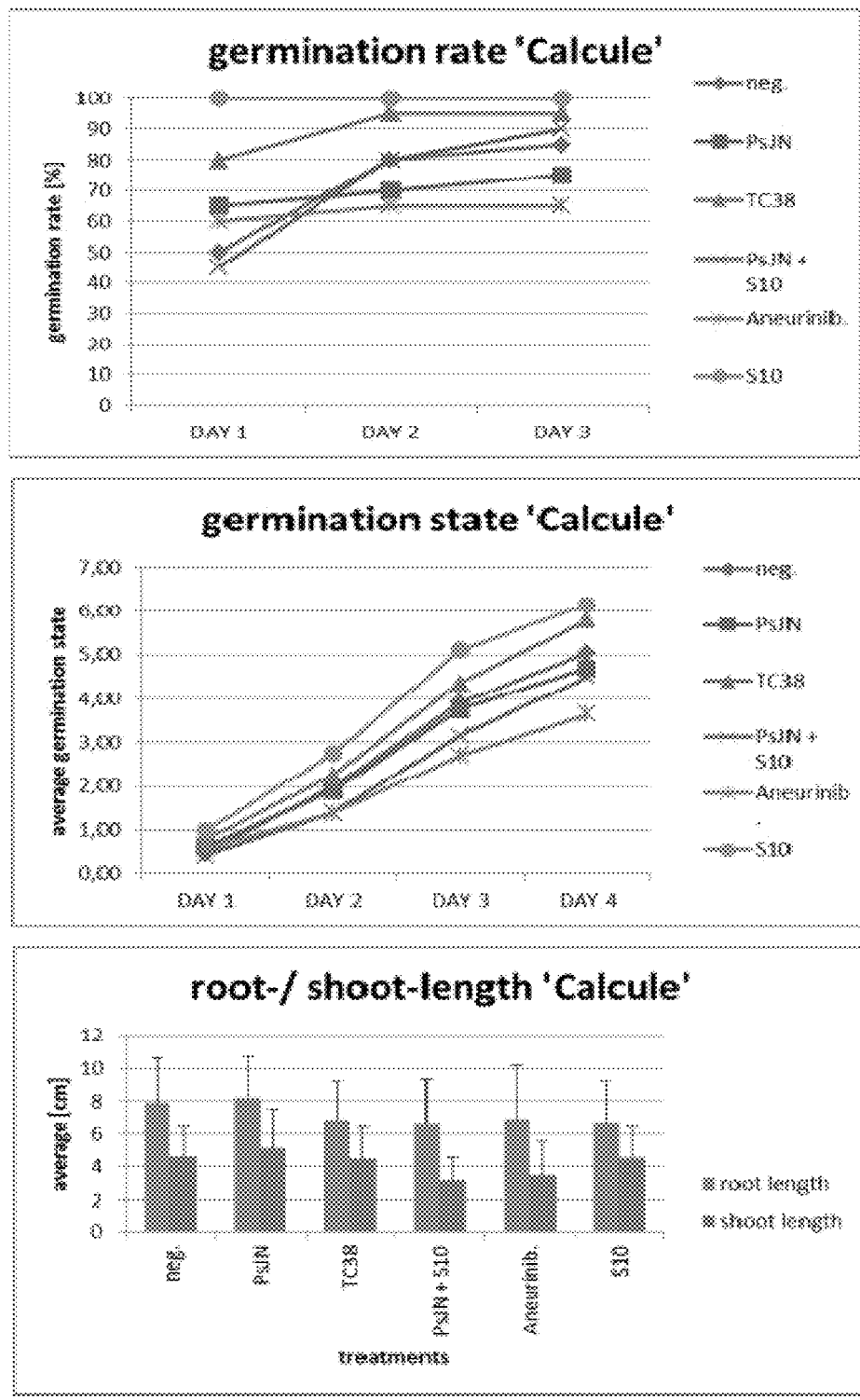

In this experiment the effect of bacteria of different phylogeny and origin introduced into seeds of summer wheat and barley on seed germination and seeding growth has been tested. PsJN, TC38 and S10 endoseeds of summer wheat cultivar Trappe showed increased germination rate as compared to control seeds. Eighty-five % of control seeds germinated whereas 100% of PsJN- and S10-endoseeds and 95% of TC38-endoseeds were germinated after three days FIG. 42). No effect on germination time and seedling growth was found in cultivar Trappe and no effect on any of the tested parameters was found in cultivar Kronjet. Barley seeds responded stronger to the incorporated bacteria than the wheat seed. Effects were found for germination rate, germination time and seedling length (FIG. 42). Four strains and combinations (TC38, S10, S10+PsJN, and AB) increased germination rate and germination time of barley cv. Eunova. Fifty-five % of control seeds germinated whereas 80% of endoseeds treated with the abovementioned strains was fully germinated within three days. Accordingly, the development of seedling of these endoseeds was also faster than in the control seeds. In addition, seedling emerging from TC38 and S10-endoseeds of cultivar Eunova showed increased root and shoot length (FIG. 42). In the barley cultivar Calcule only strain S10 had a positive effect on germination rate and time. After three days 100% of S10-endoseeds were germinated whereas 85% of control seeds were germinated. The development of S10-endoseed seedlings was faster than that of control seeds or any other endoseeds. No effect was found on root and shoot length Calcule seedlings.

Conclusion for Example 12

Bacterial strains introduced into seeds upon spraying flowers of parent plants had a stimulating effect on seed germination and seedling growth in summer wheat and barley. Both, gram-positive (S10, AB) and gram-negative (TC38) bacteria were found to be able to increase germination and seedling growth in summer wheat and barley when introduced into the seeds. Strains of different origin were able to increase germination and seedling growth of summer wheat (PsJN isolated from onion roots, TC38 isolated from maize roots, S10 isolated form maize seeds) and of barley (TC38, S10 and AB isolated from summer wheat).

Example 13: Effect of PsJN Incorporated into Wheat (*Triticum aestivum* cv. Trappe) Seeds (Endoseed) or Coated on Seeds (Exoseed) on Plant Growth and Spike Onset This greenhouse test was conducted to determine the difference in germination, growth and flower onset between summer wheat (*Triticum aestivum* cv. Trappe) growing out of (1) seeds internally carrying *Burkholderia phytofirmans*, (2) seeds coated with PsJN and (3) not treated control seeds.
Experimental Description
Endoseeds and control seeds were prepared in a field in 2014 as in Example 9. The colonization of endoseeds by strain PsJN has been tested prior to this experiment. Eighty-eight % of the seeds carried PsJN cells at a detectable level ($10^2$ to $10^3$ copies per seed).
The following treatments were used in this experiment:
summer wheat cv. Trappe PsJN endoseed later named Endo
summer wheat cv. Trappe control seeds coated with PsJN later named Exo
summer wheat cv. Trappe control seeds treated with sterile broth
For the preparation of bacterial inoculum for seed coating single colonies of *Burkholderia phytofirmans* PsJN were used to inoculate 3 glass tubes filled with 5 mL sterile 10% tryptic soy broth and bacteria were grown over night at 28° C. on a rotary shaker at 200 rpm. Glass tubes filled with sterile broth only were carried along as negative control to ensure that the broth used was sterile. At the flowing day (Oct. 3, 2014), the bacterial suspensions were pooled and adjusted to a concentration of $5\times10^8$ cfu/mL with 10% tryptic soy broth. Summer wheat seeds were incubated with the bacterial suspension (about 15 mL) in petri dishes (Ø 60 mm) for two hours. EndoSeeds and control seeds were inoculated in 15 mL of sterile 10% tryptic soy broth in petri dishes (Ø 60 mm) for two hours, to make sure all seeds have the same start value of nutrients due to the medium.

After inoculation each batch of 24 moist seeds was sown in multipot plates with a single pot diameter of 5.5 cm and a depth of 6 cm containing pot soil (Einheitserde special-Topfsubstrat ED 63). Trays were watered with tap water.

Regular rating of germination rate was conducted on a daily basis starting on day 3 until day 10. During this period plants were still in multipot plates. From day 11 onwards only height was measured as germination was finished.

Figure 43:
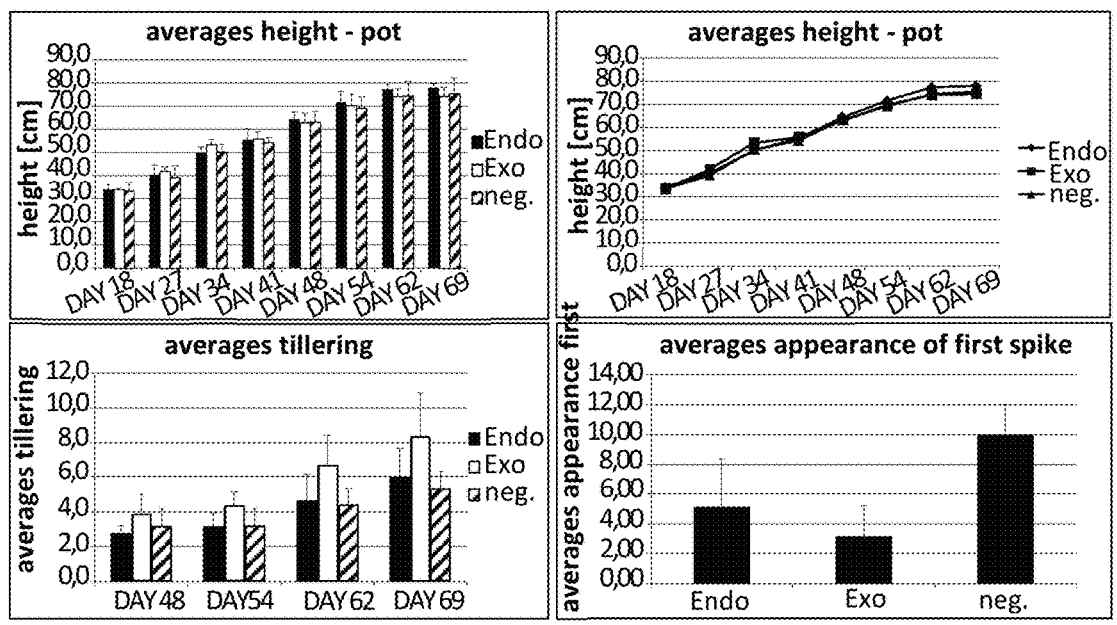
FIG. 43 shows the effect of PsJN incorporated into summer wheat (*Triticum aestivum* cv. Trappe) seeds (endoseed) or coated on seeds (exoseed) on seed plant growth, tillering and spike onset as compared to control plants.

On day 17, six plants per treatment were potted individually in pots with a diameter of 15 cm, containing pot soil (Einheitserde special-Topfsubstrat ED 63). Height was measured once a week until day 69. From day 48 forward, the number of tillers was also counted once per week. The appearance of the first spike per plant was monitored between Dec. 4, 2014 and Dec. 15, 2014. The day on which first spike on the first plant was observed (Dec. 4, 2014) was rated with 1, and subsequent days were rated in ascending order, i.e. if the first spike on a particular plant was observed on Dec. 7, 2014, the plant was rated with a 4. Accordingly the lower the overall value the sooner the spike appeared.
Experimental Results
Strain PsJN had no effect on plant growth in summer wheat (*Triticum aestivum* cv. Trappe) irrespectively of whether it was internally colonizing the seeds ("Endo") or applied as seed coating ("Exo") (FIG. 43). Tillering was increased upon PsJN treatment whereby the application as a seed coating was more effective than the PsJN-endoseeds. Both seed treatments with PsJN reduced remarkably the time until spike onset. On average the spikes of plants emerging from PsJN-endoseeds appeared five days earlier than of control plants. This effect was even more pronounced in plants emerging from seeds coated with PsJN where the spikes appeared seven days earlier than in the control plants. In this context it needs to be taken in account that the cell number of PsJN in endoseeds was most probably lower ($10^2$ to $10^3$ copy numbers per seed) than in the seed coating ($10^8$ CFU/mL) applied. Moreover, about 88% of endoseeds were colonized by PsJN whereas 100% of Exo-seeds were treated with PsJN.

Conclusion for Example 13

Application of *B. phytofirmans* PsJN on summer wheat seeds reduced the developmental time until spike formation and thus speeded up maturity of the host plant in both types of applications—as seed coating and endoseed.

Example 14: Determination of Colonization Rates of Individual Endoseeds of the Same Head The purpose of this experiment is to determine the extent of colonization of endoseeds from different locations on a spike for summer wheat cultivar Trappe, and the colonization rate of individual seeds from a soybean pod. In each case, the endoseed was generated using *Burkholderia phytofirmans* (PsJN).
Experiment Description
Endoseeds and control seeds were prepared in a field in 2014 as in Example 9. At time of harvest ten individual heads per treatment were harvested.

Endoseeds used in this experiment:
  Summer wheat cv. Trappe treated with *Burkholderia phytofirmans* PsJN
  Summer wheat cv. Trappe treated with steril buffer
  Quantification of PsJN in endoseeds was achieved by strain specific qPCR. Seeds were surface-sterilized by soaking the seeds in 70% ethanol for 3 min followed by 5% sodium hypochloride for 5 min, and washed three times with sterile distilled water (1 min for each wash). Seeds and aliquots of the final wash were plated on LB plates to verify the efficiency of surface sterilization. Seeds were considered to be successfully sterilized when no colonies were observed on the LB plates after inoculation for 3 days at 28° C. Single surface-sterilized seeds were aseptically peeled using a scalpel, cut in pieces and crushed using a sterile mortar. Seed material was homogenized for 30 s in lysing matrix E (MPbio DNA isolation kit from soil) using in a bead beater (FastPrep FP 120, Bio101, Savant Instruments, Inc., Holbrook, N.Y.). DNA was then extracted with the MPbio DNA isolation kit from soil (MP Biomedicals, Solon, Ohio, USA) according to protocol provided by the manufacturer.

For quantification of *Burkholderia phytofirmans* PsJN, the obtained DNA from the isolation steps was used to perform a quantitative real time PCR using a Taqman probe and a Biorad CFX96 real-time detection system. The probe was designed in a previous study to match the DNA amplicon (transcription termination factor rho) produced by the primers 1824 Forward and 1824 Reverse (Bphyt_1824 Fw and Re). The sequence of the forward primer was AAAAAC-GAGCCAAAAGGGC (5' →3'), SEQ ID 1229, the sequence of the reverse primer was CGTTATTTCGCGCTGGTG (5'→3'), SEQ ID 1230. The sequence of this probe was AAACCTCGTACCTCGCCAGC (5'→3'), SEQ ID 1377. The probe is equipped with a FAM (6-FAM-phosphoramidit-fluorescent dye) on the 5' end, and a BHQ-1 (Black hole quencher 1) on the 3' end. A BioRad SsoFast Probe Supermix was used to provide the ideal conditions for the probe during the PCR.

For qPCR standard preparation, chromosomal DNA of *B. phytofirmans* PsJN was isolated using FastDNA™ SPIN Kit for soil (MP Biomedicals, LLC) according the manufacter protocol. DNA concentration was determined using a Nanotrop and doing five replicate measurements. The mean value was used for further calculations. The number of DNA copies was calculated as follows:

$$\text{number of copies} = \frac{DNA \text{ quantity}\left(\frac{g}{\mu l}\right)}{\text{fragment length} * 660 \text{ g/mol}} * 6.022 * 10^{23}$$

where fragment length is 8214658 bp (size of PsJN genome). For absolute quantification of DNA in seed samples, a calibration curve was generated from the real-time qPCR results of 3 respective replicates of a 10-fold serial dilution of the purified chromosomal DNA of PsJN. Unknown starting quantity of DNA copy numbers in the samples were calculated based on a standard curve. All data analysis was performed using the software Bio-Rad CFX Manager 3.0. Results were considered as positive when the starting quantity estimated was at least 10 copies. Only seeds for which two out of three replicates in qPCR gave a positive signal were considered to be colonized by strain PsJN.
  Experiment Results
  In general, PsJN was found in seeds of heads of summer wheat and barley (Table X, Table Y, Table Z, and Table AA).

Single heads were not evenly colonized by strain PsJN and the number of colonized seeds varied strongly from head to head.

TABLE X qPCR results of summer wheat (Trappe). Numbers indicate seeds positive in PsJN specific qPCR of total number of seeds tested. Base middle and top refer to seed positions for each of 8 samples (PsJN-endoseed).

| Head | T-PsJN (top) | T-PsJN (middle) | T-PsJN (bottom) |
|---|---|---|---|
| 1 | 0/2 | 0/2 | 2/2 |
| 2 | 1/2 | 1/2 | 2/2 |
| 3 | 2/2 | 1/2 | 1/2 |
| 4 | 2/2 | 0/2 | 1/2 |
| 5 | 0/2 | 0/2 | 0/2 |
| 6 | 0/2 | 0/2 | 0/2 |
| 7 | 0/2 | 1/2 | 0/2 |
| 8 | 0/2 | 0/2 | 0/2 |

TABLE Y qPCR results of summer wheat (Kronjet). Numbers indicate seeds positive in PsJN specific qPCR of total number of seeds tested. Base middle and top refer to seed positions for each of 8 samples (PsJN-endoseed).

| Head | K-PsJN (top) | K-PsJN (middle) | K-PsJN (bottom) |
|---|---|---|---|
| 1 | 0/2 | 0/2 | 0/2 |
| 2 | 0/2 | 0/2 | 0/2 |
| 3 | 0/2 | 0/2 | 0/2 |
| 4 | 0/2 | 0/2 | 1/2 |
| 5 | 1/2 | 0/2 | 0/2 |
| 6 | 2/2 | 1/2 | 0/2 |
| 7 | 0/2 | 0/2 | 0/2 |
| 8 | 0/2 | 0/2 | 1/2 |

TABLE Z qPCR results of barley (Calcule). Numbers indicate seeds positive in PsJN specific qPCR of total number of seeds tested. Base middle and top refer to seed positions for each of 8 samples (PsJN-endoseed).

| Head | C-PsJN (top) | C-PsJN (middle) | C-PsJN (bottom) |
|---|---|---|---|
| 1 | 1/2 | 0/2 | 1/2 |
| 2 | 1/2 | 1/2 | 1/2 |
| 3 | 2/2 | 1/2 | 2/2 |
| 4 | 0/2 | 1/2 | 1/2 |
| 5 | 0/2 | 0/2 | 0/2 |
| 6 | 0/2 | 0/2 | 0/2 |
| 7 | 0/2 | 0/2 | 0/2 |
| 8 | 0/2 | 0/2 | 0/2 |

TABLE AA qPCR results of barley (Eunova). Numbers indicate seeds positive in PsJN specific qPCR of total number of seeds tested. Base middle and top refer to seed positions for each of 8 samples (PsJN-endoseed).

| Head | Control (base) | Control (middle) | Control (top) | E-PsJN (top) | E-PsJN (middle) | E-PsJN (bottom) |
|---|---|---|---|---|---|---|
| 1 | 2/2 | 0/2 | 0/2 | 1/2 | 2/2 | 1/2 |
| 2 | 0/2 | 1/2 | 1/2 | 1/2 | 1/2 | 1/2 |
| 3 | 0/2 | 2/2 | 0/2 | 2/2 | 2/2 | 0/2 |

TABLE AA-continued qPCR results of barley (Eunova). Numbers indicate seeds positive in PsJN specific qPCR of total number of seeds tested. Base middle and top refer to seed positions for each of 8 samples (PsJN-endoseed).

| Head | Control (base) | Control (middle) | Control (top) | E-PsJN (top) | E-PsJN (middle) | E-PsJN (bottom) |
|---|---|---|---|---|---|---|
| 4 | 2/2 | 2/2 | 0/2 | 1/2 | 2/2 | 0/2 |
| 5 | n.d. | n.d. | n.d. | 1/2 | 1/2 | 1/2 |
| 6 | n.d. | n.d. | n.d. | 0/2 | 0/2 | 1/2 |
| 7 | n.d. | n.d. | n.d. | 1/2 | 0/2 | 0/2 |
| 8 | n.d. | n.d. | n.d. | 1/2 | 1/2 | 0/2 |

Conclusions

Seeds of single heads were not evenly colonized by *B. phytofirmans* PsJN that had been applied by spraying flowers of parent plants.

Example 15: Drought Stress Assay with Seeds of *Hordeum vulgare*

The goal of this drought stress assay was to find out if there is a difference in the resistance to drought stress between endoseeds and untreated seeds of barley (*Hordeum vulgare* 'Eunova' and 'Calcule') inoculated with *Burkholderia phytofirmans* (PsJN), *Flavobacterium* sp. (TC38), *Paenibacillus tundrae* (S10), a mixture of *Paenibacillus tundrae* and *Burkholderia phytofirmans* (S10+PsJN) or *Aneurinibacillus* sp. Differences in germination were also rated.

Experiment Description

Germination Assay:

Tested treatments are PsJN-EndoSeeds, TC38-EndoSeeds, 510-EndoSeeds, S10+PsJN-EndoSeeds, *Aneurinibacillus*-EndoSeeds and two negative controls (F1 and F2 generation). Treatments were tested in 20 replicates each. Endo-Seeds and negative control F2 were produced on the field during the season 2014. Seeds were sown into unpunched seedtrays (28×24×6 cm). Right after sowing irrigation by hand took place.

Regular rating of the germination state (Table BB) and germination rate took place from day 1 until day 14, except germination rate, which only got rated until day 7 because as germination was finished by then.

To generate a drought stress, plants did not get irrigated any more from day 12 onwards. Trays needed about 2 days for drying out. First symptoms could be seen on day 15 (3 days after irrigation was stopped). Drought was rated according to Table CC.

Figure 44:
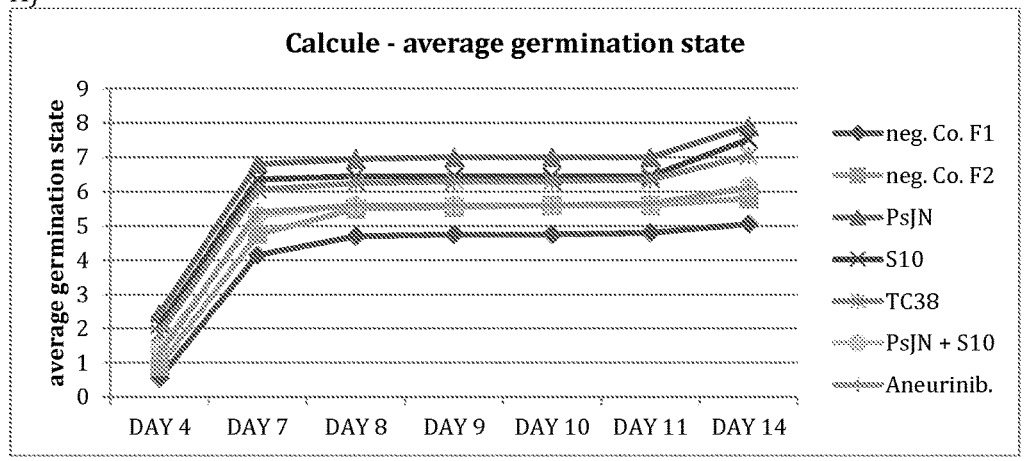
FIG. 44 shows the germination state (A), germination rate (B), and average drought stress (C) in a barley drought assay using the Calcule va.
Figure 44:
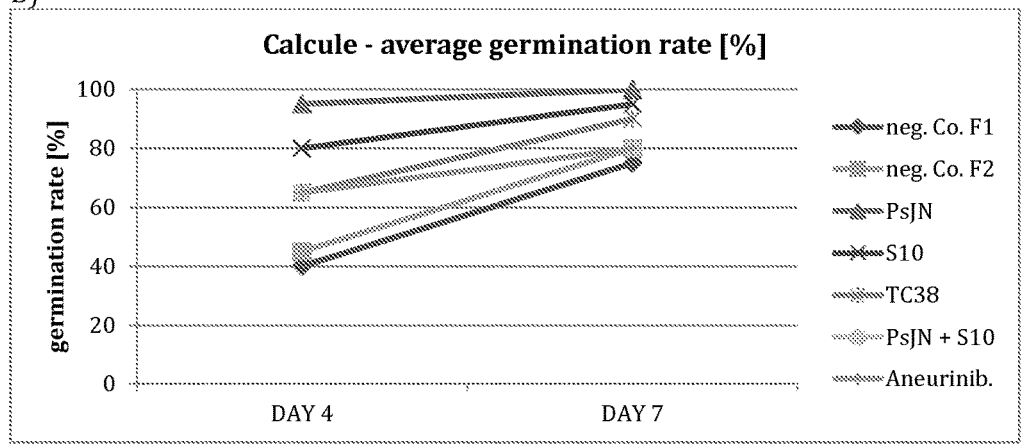
Figure 44:
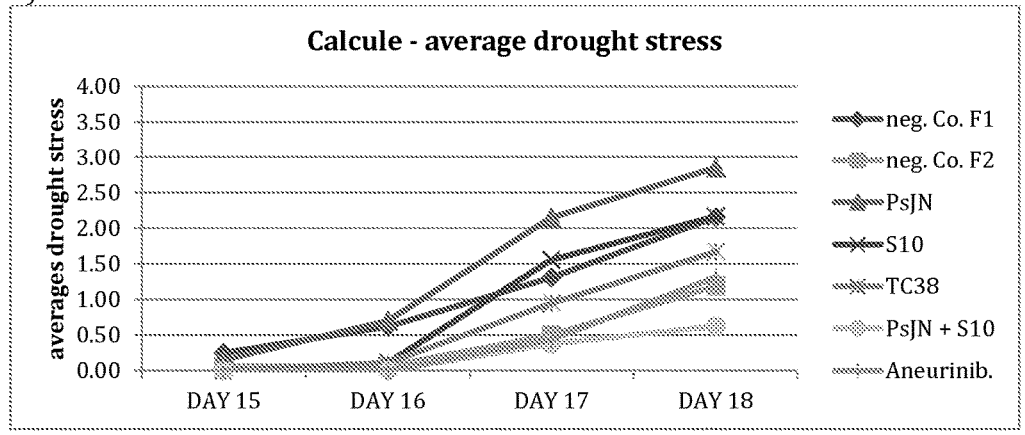
Figure 45:
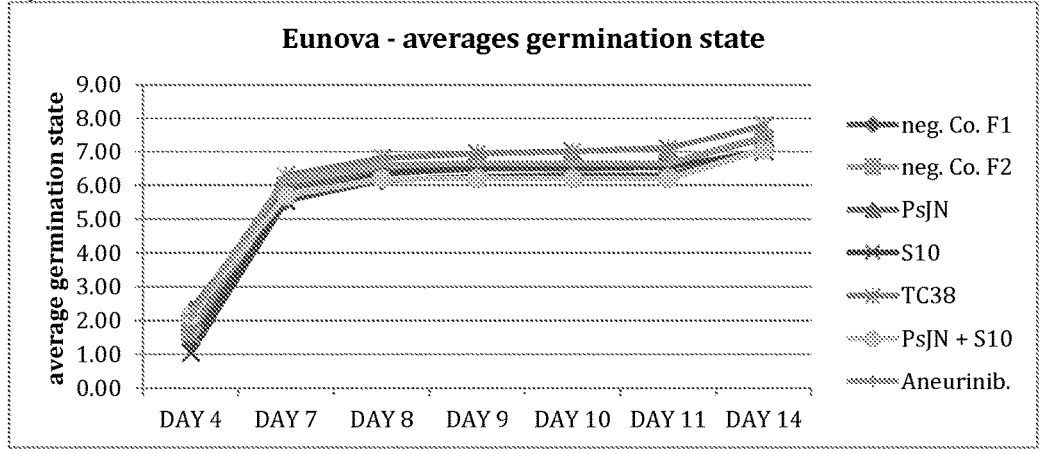
FIG. 45 shows the germination state (A), germination rate (B), and average drought stress (C) in a barley drought assay using the Eunova va.
Figure 45:
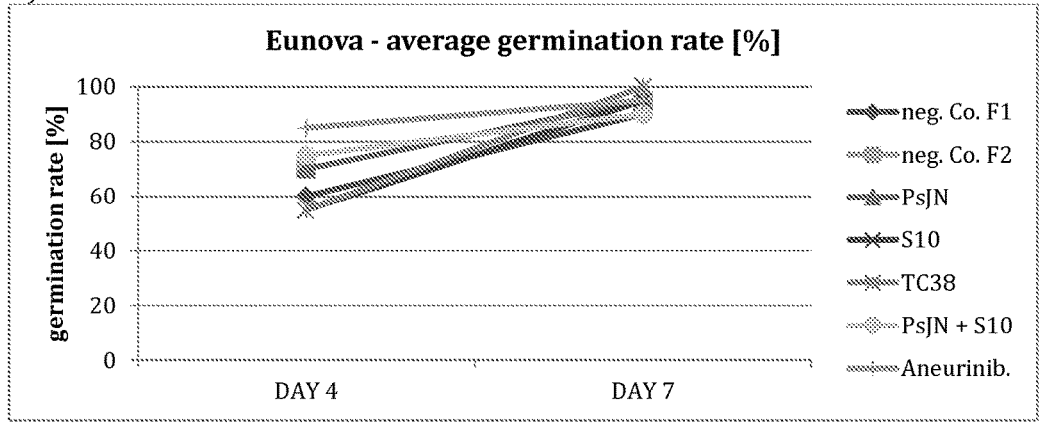
Figure 45:
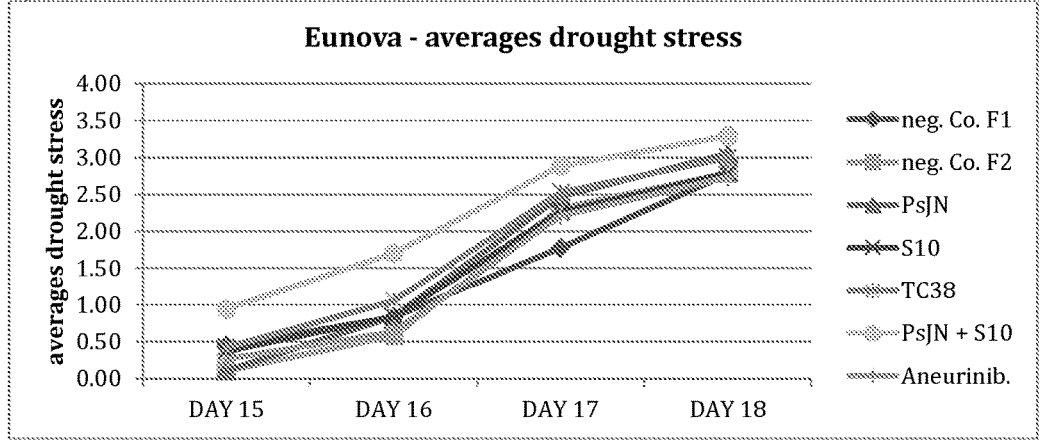

Data of the germination state, germination rate, and drought stress are seen in FIG. 44 (Calcule) and FIG. 45 (Eunova).

TABLE BB rating system for germination state type of germination

| | |
|---|---|
| 0 | no germination |
| 1 | germination |
| 2 | germinated, cotyledon closed |
| 3 | erect, cotyledon closed |
| 4 | cotyledon visible but closed |
| 5 | cotyledon visible but not fully opened |
| 6 | cotyledon fully opened |
| 7 | cotyledon completely opened + new shoot |
| 8 | 2. shoot |
| 9 | additional shoots |

TABLE CC rating system for type of drought stress type of drought stress

| | |
|---|---|
| 0 | no wilting |
| 1 | plant is droopy, leaves start curling |
| 2 | cotyledon starts wilting |
| 3 | cotyledon dried up, real leaves begin to wilt till are dried up |
| 4 | all parts of the plant are dried up |

Results

In this experiment the effect of bacteria of different phylogeny and origin introduced into seeds of barley on seedling response to drought stress. The results are summarized in FIGS. 44 and 45. Barley seeds responded to the incorporated bacteria. Effects were found for germination rate, germination time and silencing of drought stress symptoms. Three strains and combinations (PsJN, TC38, S10) increased germination rate and germination time of barley cv. Calcule (FIGS. 44 and 45). Seedlings emerging from PsJN+S10- or AB-endoseeds of barley cv. Calcule showed weaker symptoms of drought stress than control seeds.

Conclusions

Bacterial strains introduced into seeds upon spraying flowers of parent plants had a silencing effect on plant drought stress symptoms. Both gram-positive (S10, AB) and gram-negative (PsJN) bacteria were able to increase drought stress resistance in seedlings of barley when introduced into the seeds.

Example 16: Localization of Microbes in the Plant and its Environment

The localization within the plant and its environment was determined for seed endophytes from corn and wheat seeds.

Experiment Description:

To determine bacterial taxa inhabiting different plant compartments, seeds were germinated in soil in sterile tubes, and plant tissue was harvested. 12 corn seeds (Blue River hybrids, 40R73) and 12 wheat seeds (Briggs, developed by South Dakota University) were planted in separate culture tubes containing 12.5 ml of a 1:1 soil (type, supplier) to sand (v/v) mixture. 2.5 ml autoclaved deionized water was added to each tube, and they were fitted with caps. Tubes were placed in a growth chamber where plants were allowed to grow for 14 d Rhizosphere, root, and aerial tissue was harvested using a technique similar to (Lundberg et al. 2012). Briefly, aerial tissue was removed using sterilized forceps and scissors, placed in a sterile conical tube, and rinsed with 70% ethanol and sterile deionized water to remove superficial microbial cells Rhizosphere samples were taken by removing loose soil from roots, adding the roots with remaining soil to a 50 ml conical tube containing 10 ml sterile deionized water, vortexing the tube for 10 s, and removing the roots. Soil particles in the tubes were allowed to settle and the supernatant was decanted. Root samples were cleaned of remaining superficial soil and associated microbial cells using sterile water and forceps and a 70% ethanol rinse.

Microbial composition was assessed in each sample using high-throughput sequencing of the V4 hypervariable region of the 16S rRNA gene (Fierer et al. 2012). DNA was extracted from the samples using the PowerPlant Pro DNA extraction kit (Mo Bio Laboratories, Inc., Carlsbad, Calif.) according to the manufacturer's instructions. The DNA was subjected to 35-cycle PCR amplification with the 515f/806r primer pair containing error-correcting 12-bp barcoded primers specific to each sample in order to facilitate combining the samples prior to sequencing. To reduce the amplification of chloroplast and mitochondrial DNA, we used PNA clamps specific to the rRNA genes in these organelles (Lundberg et al. 2013). PCR products were quantified using the PicoGreen assay (Life Technologies, Inc., Grand Island, N.Y.), pooled in equimolar concentrations, and cleaned using the UltraClean kit (Mo Bio Laboratories, Inc., Carlsbad, Calif.). Cleaned DNA pools were sequenced on an Illumina MiSeq instrument at the University of Colorado Next Generation Sequencing Facility.

The raw sequence data were reassigned to distinct samples using a custom Python script, and quality filtering and OTU (i.e. operational taxonomic unit) clustering was conducted using the UPARSE pipeline (Edgar 2013). Briefly, a de novo sequence database with representative sequences for each OTU was created using a 97% similarity threshold, and raw reads were mapped to this database to calculate sequence counts per OTU per sample. Prior to creating the database, sequences were quality filtered using an expected error frequency threshold of 0.5 errors per sequence. In addition, sequences were dereplicated and singletons were removed prior to creating the database. OTUs were provided taxonomic classifications using the RDP classifier (Wang et al. 2007) trained with the Greengenes database (McDonald et al. 2012). To account for differences in the variable number of sequences per sample, each sample was rarefied to 200 sequences per sample. OTUs classified as chloroplasts or mitochondria were discarded prior to rarefaction.

Overall differences in bacterial community composition between the control and inoculated plants were evaluated using non-metric multidimensional scaling based on Bray-Curtis dissimilarities in order to visualize pairwise differences between sample communities. Permutational analysis of variance (PERMANOVA) was used to statistically test the significance of these differences. Analyses were conducted using the vegan package in R (R Core Team 2013). To determine the OTUs contributing to overall differences between treatments and control groups, mean relative abundances were calculated for each OTU within each group. Only OTUs with a mean relative abundance of 0.25% in either group were included in this analysis.

Experiment Results

Figure 49:
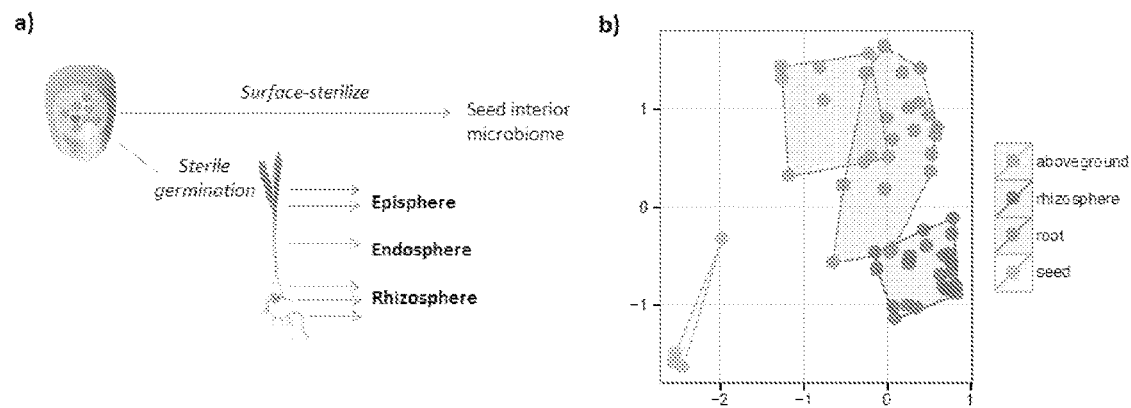
FIG. 49 shows the community differences for samples taken from above ground, root, and rhizosphere tissues of plant-based bioreactors. Panel (A) shows the schematic of the process for germinating seeds under sterile conditions with a diverse initial seed microbiome and subsequent sampling of the above ground (episphere), endosphere (root), and rhizosphere communities via bar-coded community sequencing. Panel (B) shows that distinct bacterial communities live within the different plant tissues, with each tissue being populated from microbes derived from the initial seed microbiome.

The bacterial taxa that are found in the root, aerial, seed tissue and/or rhizosphere of the germinated corn and wheat seeds are shown in Table DD, EE, FF, and GG. FIG. 49 shows the community differences for samples taken from above ground, root, and rhizosphere tissues.

TABLE DD

Bacterial endophytes found in the root tissue

| OTU_ID | SEQ ID NO: | Class | Order | Family | Genus |
|---|---|---|---|---|---|
| OTU_73 | 1344 | Gammaproteobacteria | Xanthomonadales | Xanthomonadaceae | Xanthomonas |
| OTU_188 | 1365 | Actinobacteria | Actinomycetales | Microbacteriaceae | Salinibacterium |
| OTU_90 | 1364 | Gammaproteobacteria | Pseudomonadales | Moraxellaceae | Acinetobacter |
| OTU_115 | 1306 | Betaproteobacteria | Methylophilales | Methylophilaceae | Methylotenera |
| OTU_13 | 1340 | Bacilli | Bacillales | Bacillaceae | Bacillus |
| OTU_3194 | 1325 | Alphaproteobacteria | Sphingomonadales | Sphingomonadaceae | Sphingomonas |
| OTU_3034 | 1299 | Alphaproteobacteria | Sphingomonadales | Sphingomonadaceae | Novosphingobium |
| OTU_127 | 1281 | Alphaproteobacteria | BD7-3 | | |
| OTU_134 | 1362 | Bacilli | Bacillales | Paenibacillaceae | Paenibacillus |
| OTU_64 | 1311 | Alphaproteobacteria | Sphingomonadales | Sphingomonadaceae | Novosphingobium |
| OTU_290 | 1256 | [Saprospirae] | [Saprospirales] | Chitinophagaceae | Sediminibacterium |
| OTU_118 | 1231 | Gammaproteobacteria | Enterobacteriales | Enterobacteriaceae | Enterobacter |
| OTU_3760 | 1339 | Betaproteobacteria | Burkholderiales | Alcaligenaceae | Achromobacter |
| OTU_2272 | 1232 | Betaproteobacteria | Burkholderiales | Comamonadaceae | Polaromonas |
| OTU_99 | 1337 | [Saprospirae] | [Saprospirales] | Chitinophagaceae | |
| OTU_119 | 1259 | Sphingobacteriia | Sphingobacteriales | Sphingobacteriaceae | |
| OTU_24 | 1265 | Flavobacteriia | Flavobacteriales | [Weeksellaceae] | Chryseobacterium |
| OTU_85 | 1243 | Alphaproteobacteria | Caulobacterales | Caulobacteraceae | Phenylobacterium |
| OTU_108 | 1282 | Bacilli | Bacillales | Paenibacillaceae | Ammoniphilus |
| OTU_121 | 1373 | Bacilli | Bacillales | Paenibacillaceae | Paenibacillus |
| OTU_2406 | 1361 | Bacilli | Bacillales | Paenibacillaceae | Cohnella |
| OTU_3268 | 1257 | Cytophagia | Cytophagales | Cytophagaceae | Dyadobacter |
| OTU_604 | 1330 | Alphaproteobacteria | Sphingomonadales | Erythrobacteraceae | |
| OTU_367 | 1370 | Alphaproteobacteria | Sphingomonadales | Erythrobacteraceae | |
| OTU_124 | 1368 | Alphaproteobacteria | Rhodospirillales | Rhodospirillaceae | Azospirillum |
| OTU_343 | 1336 | Cytophagia | Cytophagales | Cytophagaceae | Dyadobacter |
| OTU_130 | 1343 | Flavobacteriia | Flavobacteriales | Flavobacteriaceae | Flavobacterium |
| OTU_89 | 1303 | Bacilli | Bacillales | | |
| OTU_70 | 1245 | Cytophagia | Cytophagales | Cytophagaceae | |
| OTU_65 | 1239 | Verrucomicrobiae | Verrucomicrobiales | Verrucomicrobiaceae | Prosthecobacter |
| OTU_43 | 1249 | Sphingobacteriia | Sphingobacteriales | Sphingobacteriaceae | Pedobacter |
| OTU_3678 | 1359 | Gammaproteobacteria | Xanthomonadales | Xanthomonadaceae | Rhodanobacter |
| OTU_123 | 1351 | Actinobacteria | Actinomycetales | Micrococcaceae | Arthrobacter |
| OTU_79 | 1290 | [Saprospirae] | [Saprospirales] | Chitinophagaceae | Flavisolibacter |
| OTU_87 | 1293 | [Saprospirae] | [Saprospirales] | Chitinophagaceae | |
| OTU_264 | 1354 | Bacilli | Bacillales | Paenibacillaceae | Paenibacillus |
| OTU_217 | 1301 | Bacilli | Bacillales | Planococcaceae | Paenisporosarcina |
| OTU_9 | 1291 | Gammaproteobacteria | Pseudomonadales | Pseudomonadaceae | Pseudomonas |
| OTU_1 | 1236 | Gammaproteobacteria | Enterobacteriales | Enterobacteriaceae | Pantoea |
| OTU_69 | 1264 | Betaproteobacteria | IS-44 | | |
| OTU_139 | 1326 | Bacilli | Bacillales | | |
| OTU_399 | 1270 | Verrucomicrobiae | Verrucomicrobiales | Verrucomicrobiaceae | Luteolibacter |
| OTU_104 | 1338 | Bacilli | Bacillales | Paenibacillaceae | Paenibacillus |
| OTU_71 | 1335 | Alphaproteobacteria | Rhizobiales | Bradyrhizobiaceae | Bradyrhizobium |

TABLE DD-continued

Bacterial endophytes found in the root tissue

| OTU_ID | SEQ ID NO: | Class | Order | Family | Genus |
|---|---|---|---|---|---|
| OTU_72 | 1251 | [Saprospirae] | [Saprospirales] | Chitinophagaceae | Sediminibacterium |
| OTU_204 | 1353 | Alphaproteobacteria | Rhizobiales | Rhizobiaceae | Agrobacterium |
| OTU_141 | 1367 | Alphaproteobacteria | Sphingomonadales | Sphingomonadaceae | Sphingomonas |
| OTU_50 | 1363 | Alphaproteobacteria | Sphingomonadales | Sphingomonadaceae | Sphingomonas |
| OTU_56 | 1266 | Deltaproteobacteria | Myxococcales | | |
| OTU_16 | 1237 | Bacilli | Bacillales | Paenibacillaceae | Paenibacillus |
| OTU_2969 | 1242 | Bacilli | Bacillales | Bacillaceae | |
| OTU_183 | 1333 | Alphaproteobacteria | Caulobacterales | Caulobacteraceae | Mycoplana |
| OTU_61 | 1300 | Cytophagia | Cytophagales | Cytophagaceae | Dyadobacter |
| OTU_75 | 1287 | [Saprospirae] | [Saprospirales] | Chitinophagaceae | Flavisolibacter |
| OTU_68 | 1283 | Betaproteobacteria | Burkholderiales | Comamonadaceae | |
| OTU_76 | 1273 | Gammaproteobacteria | Xanthomonadales | Xanthomonadaceae | Rhodanobacter |
| OTU_2017 | 1286 | Sphingobacteriia | Sphingobacteriales | Sphingobacteriaceae | Pedobacter |
| OTU_29 | 1289 | Gammaproteobacteria | Xanthomonadales | Xanthomonadaceae | |
| OTU_86 | 1342 | Alphaproteobacteria | Caulobacterales | Caulobacteraceae | Caulobacter |
| OTU_78 | 1269 | [Saprospirae] | [Saprospirales] | Chitinophagaceae | |
| OTU_22 | 1322 | Bacilli | Bacillales | Paenibacillaceae | Cohnella |
| OTU_2460 | 1285 | Betaproteobacteria | Burkholderiales | Oxalobacteraceae | Janthinobacterium |
| OTU_66 | 1309 | Flavobacteriia | Flavobacteriales | Flavobacteriaceae | Flavobacterium |
| OTU_3062 | 1302 | Bacilli | Bacillales | Paenibacillaceae | Cohnella |
| OTU_18 | 1296 | Bacilli | Bacillales | Paenibacillaceae | Paenibacillus |
| OTU_2966 | 1334 | Alphaproteobacteria | Rhizobiales | Hyphomicrobiaceae | Devosia |
| OTU_54 | 1323 | Sphingobacteriia | Sphingobacteriales | | |
| OTU_92 | 1305 | Deltaproteobacteria | Myxococcales | Polyangiaceae | Chondromyces |
| OTU_60 | 1358 | Bacilli | Bacillales | Paenibacillaceae | Paenibacillus |
| OTU_63 | 1292 | Planctomycetia | Pirellulales | Pirellulaceae | |
| OTU_2433 | 1295 | Alphaproteobacteria | Rhizobiales | Rhizobiaceae | |
| OTU_95 | 1308 | [Saprospirae] | [Saprospirales] | Chitinophagaceae | |
| OTU_62 | 1376 | Alphaproteobacteria | Sphingomonadales | Sphingomonadaceae | Sphingomonas |
| OTU_356 | 1310 | Betaproteobacteria | Burkholderiales | Comamonadaceae | Simplicispira |
| OTU_176 | 1328 | Alphaproteobacteria | Caulobacterales | Caulobacteraceae | Mycoplana |
| OTU_91 | 1267 | Deltaproteobacteria | Myxococcales | | |
| OTU_148 | 1349 | Betaproteobacteria | Burkholderiales | Comamonadaceae | |
| OTU_53 | 1345 | Flavobacteriia | Flavobacteriales | Flavobacteriaceae | Flavobacterium |
| OTU_3272 | 1347 | Bacilli | Bacillales | Paenibacillaceae | Brevibacillus |
| OTU_2819 | 1268 | Alphaproteobacteria | Rhizobiales | Hyphomicrobiaceae | Devosia |
| OTU_57 | 1284 | Alphaproteobacteria | Rhizobiales | Hyphomicrobiaceae | Devosia |
| OTU_1751 | 1279 | Gammaproteobacteria | Alteromonadales | Alteromonadaceae | Cellvibrio |
| OTU_67 | 1360 | Bacilli | Bacillales | Paenibacillaceae | Paenibacillus |
| OTU_41 | 1280 | Cytophagia | Cytophagales | Cytophagaceae | Cytophaga |
| OTU_51 | 1341 | Alphaproteobacteria | Rhizobiales | Rhizobiaceae | Agrobacterium |
| OTU_77 | 1357 | Betaproteobacteria | Burkholderiales | Comamonadaceae | |
| OTU_7 | 1263 | Cytophagia | Cytophagales | Cytophagaceae | Dyadobacter |
| OTU_52 | 1366 | Deinococci | Deinococcales | Deinococcaceae | Deinococcus |
| OTU_28 | 1307 | Alphaproteobacteria | Rhizobiales | Hyphomicrobiaceae | Devosia |
| OTU_23 | 1297 | [Saprospirae] | [Saprospirales] | Chitinophagaceae | Chitinophaga |
| OTU_37 | 1250 | Verrucomicrobiae | Verrucomicrobiales | Verrucomicrobiaceae | Luteolibacter |
| OTU_721 | 1260 | Flavobacteriia | Flavobacteriales | Flavobacteriaceae | Flavobacterium |
| OTU_45 | 1272 | Gammaproteobacteria | Alteromonadales | Alteromonadaceae | Cellvibrio |
| OTU_42 | 1288 | Alphaproteobacteria | Caulobacterales | Caulobacteraceae | Asticcacaulis |
| OTU_10 | 1327 | Gammaproteobacteria | Xanthomonadales | Xanthomonadaceae | Stenotrophomonas |
| OTU_44 | 1238 | Alphaproteobacteria | Rhizobiales | Rhizobiaceae | Rhizobium |
| OTU_3676 | 1332 | Gammaproteobacteria | Pseudomonadales | Pseudomonadaceae | Pseudomonas |
| OTU_49 | 1255 | Betaproteobacteria | Burkholderiales | Oxalobacteraceae | Janthinobacterium |
| OTU_3658 | 1274 | Alphaproteobacteria | Rhizobiales | | |
| OTU_35 | 1375 | Bacilli | Bacillales | Paenibacillaceae | Paenibacillus |
| OTU_2846 | 1248 | Alphaproteobacteria | Rhizobiales | Rhizobiaceae | Shinella |
| OTU_34 | 1369 | Bacilli | Bacillales | Paenibacillaceae | Paenibacillus |
| OTU_33 | 1348 | Bacilli | Bacillales | Paenibacillaceae | Brevibacillus |
| OTU_17 | 1244 | Flavobacteriia | Flavobacteriales | Flavobacteriaceae | Flavobacterium |
| OTU_32 | 1271 | Betaproteobacteria | Burkholderiales | Comamonadaceae | Rhodoferax |
| OTU_15 | 1346 | Bacilli | Bacillales | Paenibacillaceae | Paenibacillus |
| OTU_2408 | 1374 | Gammaproteobacteria | Enterobacteriales | Enterobacteriaceae | |
| OTU_5 | 1278 | Alphaproteobacteria | Rhizobiales | Rhizobiaceae | Agrobacterium |
| OTU_4 | 1352 | Gammaproteobacteria | Pseudomonadales | Pseudomonadaceae | Pseudomonas |
| OTU_3 | 1276 | Betaproteobacteria | Burkholderiales | Oxalobacteraceae | Janthinobacterium |

TABLE EE

Bacterial endophytes found in the shoot tissue

| OTU_ID | SEQ ID NO: | Class | Order | Family | Genus |
|---|---|---|---|---|---|
| OTU_37 | 1250 | Verrucomicrobiae | Verrucomicrobiales | Verrucomicrobiaceae | *Luteolibacter* |
| OTU_721 | 1260 | Flavobacteriia | Flavobacteriales | Flavobacteriaceae | *Flavobacterium* |
| OTU_2819 | 1268 | Alphaproteobacteria | Rhizobiales | Hyphomicrobiaceae | *Devosia* |
| OTU_45 | 1272 | Gammaproteobacteria | Alteromonadales | Alteromonadaceae | *Cellvibrio* |
| OTU_3658 | 1274 | Alphaproteobacteria | Rhizobiales | | |
| OTU_1300 | 1275 | Deinococci | Deinococcales | Deinococcaceae | *Deinococcus* |
| OTU_1751 | 1279 | Gammaproteobacteria | Alteromonadales | Alteromonadaceae | *Cellvibrio* |
| OTU_57 | 1284 | Alphaproteobacteria | Rhizobiales | Hyphomicrobiaceae | *Devosia* |
| OTU_75 | 1287 | [Saprospirae] | [Saprospirales] | Chitinophagaceae | *Flavisolibacter* |
| OTU_87 | 1293 | [Saprospirae] | [Saprospirales] | Chitinophagaceae | |
| OTU_217 | 1301 | Bacilli | Bacillales | Planococcaceae | *Paenisporosarcina* |
| OTU_95 | 1308 | [Saprospirae] | [Saprospirales] | Chitinophagaceae | |
| OTU_66 | 1309 | Flavobacteriia | Flavobacteriales | Flavobacteriaceae | *Flavobacterium* |
| OTU_22 | 1322 | Bacilli | Bacillales | Paenibacillaceae | *Cohnella* |
| OTU_54 | 1323 | Sphingobacteriia | Sphingobacteriales | | |
| OTU_3194 | 1325 | Alphaproteobacteria | Sphingomonadales | Sphingomonadaceae | *Sphingomonas* |
| OTU_588 | 1331 | Bacilli | Bacillales | | |
| OTU_2966 | 1334 | Alphaproteobacteria | Rhizobiales | Hyphomicrobiaceae | *Devosia* |
| OTU_51 | 1341 | Alphaproteobacteria | Rhizobiales | Rhizobiaceae | *Agrobacterium* |
| OTU_86 | 1342 | Alphaproteobacteria | Caulobacterales | Caulobacteraceae | *Caulobacter* |
| OTU_3272 | 1347 | Bacilli | Bacillales | Paenibacillaceae | *Brevibacillus* |
| OTU_52 | 1366 | Deinococci | Deinococcales | Deinococcaceae | *Deinococcus* |
| OTU_70 | 1245 | Cytophagia | Cytophagales | Cytophagaceae | |
| OTU_72 | 1251 | [Saprospirae] | [Saprospirales] | Chitinophagaceae | *Sediminibacterium* |
| OTU_290 | 1256 | [Saprospirae] | [Saprospirales] | Chitinophagaceae | *Sediminibacterium* |
| OTU_96 | 1258 | Betaproteobacteria | | | |
| OTU_399 | 1270 | Verrucomicrobiae | Verrucomicrobiales | Verrucomicrobiaceae | *Luteolibacter* |
| OTU_23 | 1297 | [Saprospirae] | [Saprospirales] | Chitinophagaceae | *Chitinophaga* |
| OTU_3034 | 1299 | Alphaproteobacteria | Sphingomonadales | Sphingomonadaceae | *Novosphingobium* |
| OTU_176 | 1328 | Alphaproteobacteria | Caulobacterales | Caulobacteraceae | *Mycoplana* |
| OTU_33 | 1348 | Bacilli | Bacillales | Paenibacillaceae | *Brevibacillus* |
| OTU_134 | 1362 | Bacilli | Bacillales | Paenibacillaceae | *Paenibacillus* |
| OTU_1 | 1236 | Gammaproteobacteria | Enterobacteriales | Enterobacteriaceae | *Pantoea* |
| OTU_178 | 1246 | [Saprospirae] | [Saprospirales] | Chitinophagaceae | |
| OTU_2433 | 1295 | Alphaproteobacteria | Rhizobiales | Rhizobiaceae | |
| OTU_356 | 1310 | Betaproteobacteria | Burkholderiales | Comamonadaceae | *Simplicispira* |
| OTU_1884 | 1247 | Gammaproteobacteria | Enterobacteriales | Enterobacteriaceae | *Escherichia* |
| OTU_81 | 1254 | [Spartobacteria] | [Chthoniobacterales] | [Chthoniobacteraceae] | |
| OTU_24 | 1265 | Flavobacteriia | Flavobacteriales | [Weeksellaceae] | *Chryseobacterium* |
| OTU_85 | 1243 | Alphaproteobacteria | Caulobacterales | Caulobacteraceae | *Phenylobacterium* |
| OTU_483 | 1262 | Rubrobacteria | Rubrobacterales | Rubrobacteraceae | *Rubrobacter* |
| OTU_173 | 1298 | Actinobacteria | Actinomycetales | Nocardioidaceae | *Aeromicrobium* |
| OTU_557 | 1312 | Bacilli | Bacillales | Paenibacillaceae | *Paenibacillus* |
| OTU_584 | 1313 | Bacilli | Bacillales | Paenibacillaceae | *Paenibacillus* |
| OTU_1618 | 1315 | Bacilli | Lactobacillales | Streptococcaceae | *Streptococcus* |
| OTU_881 | 1319 | Clostridia | Clostridiales | Clostridiaceae | *Caloramator* |
| OTU_3561 | 1321 | Actinobacteria | Actinomycetales | Actinomycetaceae | *Actinomyces* |
| OTU_240 | 1324 | [Saprospirae] | [Saprospirales] | Chitinophagaceae | |
| OTU_148 | 1349 | Betaproteobacteria | Burkholderiales | Comamonadaceae | |
| OTU_1004 | 1355 | Alphaproteobacteria | Ellin329 | | |
| OTU_3042 | 1356 | Alphaproteobacteria | Sphingomonadales | Sphingomonadaceae | *Novosphingobium* |
| OTU_141 | 1367 | Alphaproteobacteria | Sphingomonadales | Sphingomonadaceae | *Sphingomonas* |
| OTU_367 | 1370 | Alphaproteobacteria | Sphingomonadales | Erythrobacteraceae | |
| OTU_1534 | 1241 | Betaproteobacteria | Burkholderiales | Oxalobacteraceae | |
| OTU_64 | 1311 | Alphaproteobacteria | Sphingomonadales | Sphingomonadaceae | *Novosphingobium* |
| OTU_3738 | 1314 | Actinobacteria | Actinomycetales | Microbacteriaceae | *Microbacterium* |
| OTU_1137 | 1317 | Clostridia | Clostridiales | Clostridiaceae | *Thermoanaerobacterium* |
| OTU_183 | 1333 | Alphaproteobacteria | Caulobacterales | Caulobacteraceae | *Mycoplana* |
| OTU_71 | 1335 | Alphaproteobacteria | Rhizobiales | Bradyrhizobiaceae | *Bradyrhizobium* |
| OTU_99 | 1337 | [Saprospirae] | [Saprospirales] | Chitinophagaceae | |
| OTU_130 | 1343 | Flavobacteriia | Flavobacteriales | Flavobacteriaceae | *Flavobacterium* |
| OTU_123 | 1351 | Actinobacteria | Actinomycetales | Micrococcaceae | *Arthrobacter* |
| OTU_204 | 1353 | Alphaproteobacteria | Rhizobiales | Rhizobiaceae | *Agrobacterium* |
| OTU_3678 | 1359 | Gammaproteobacteria | Xanthomonadales | Xanthomonadaceae | *Rhodanobacter* |
| OTU_124 | 1368 | Alphaproteobacteria | Rhodospirillales | Rhodospirillaceae | *Azospirillum* |
| OTU_118 | 1231 | Gammaproteobacteria | Enterobacteriales | Enterobacteriaceae | *Enterobacter* |
| OTU_873 | 1261 | Betaproteobacteria | Burkholderiales | Alcaligenaceae | |
| OTU_343 | 1336 | Cytophagia | Cytophagales | Cytophagaceae | *Dyadobacter* |
| OTU_53 | 1345 | Flavobacteriia | Flavobacteriales | Flavobacteriaceae | *Flavobacterium* |
| OTU_3268 | 1257 | Cytophagia | Cytophagales | Cytophagaceae | *Dyadobacter* |
| OTU_2547 | 1294 | Gammaproteobacteria | Pseudomonadales | Pseudomonadaceae | |
| OTU_615 | 1233 | Clostridia | Thermoanaerobacterales | Carboxydocellaceae | *Carboxydocella* |
| OTU_272 | 1240 | Bacilli | Bacillales | Bacillaceae | *Geobacillus* |
| OTU_68 | 1283 | Betaproteobacteria | Burkholderiales | Comamonadaceae | |
| OTU_42 | 1288 | Alphaproteobacteria | Caulobacterales | Caulobacteraceae | *Asticcacaulis* |

TABLE EE-continued

Bacterial endophytes found in the shoot tissue

| OTU_ID | SEQ ID NO: | Class | Order | Family | Genus |
|---|---|---|---|---|---|
| OTU_29 | 1289 | Gammaproteobacteria | Xanthomonadales | Xanthomonadaceae | |
| OTU_9 | 1291 | Gammaproteobacteria | Pseudomonadales | Pseudomonadaceae | *Pseudomonas* |
| OTU_188 | 1365 | Actinobacteria | Actinomycetales | Microbacteriaceae | *Salinibacterium* |
| OTU_61 | 1300 | Cytophagia | Cytophagales | Cytophagaceae | *Dyadobacter* |
| OTU_3760 | 1339 | Betaproteobacteria | Burkholderiales | Alcaligenaceae | *Achromobacter* |
| OTU_43 | 1249 | Sphingobacteriia | Sphingobacteriales | Sphingobacteriaceae | *Pedobacter* |
| OTU_1703 | 1316 | Gammaproteobacteria | Pasteurellales | Pasteurellaceae | *Haemophilus* |
| OTU_2846 | 1248 | Alphaproteobacteria | Rhizobiales | Rhizobiaceae | *Shinella* |
| OTU_28 | 1307 | Alphaproteobacteria | Rhizobiales | Hyphomicrobiaceae | *Devosia* |
| OTU_661 | 1320 | Gammaproteobacteria | Xanthomonadales | Sinobacteraceae | *Steroidobacter* |
| OTU_3 | 1276 | Betaproteobacteria | Burkholderiales | Oxalobacteraceae | *Janthinobacterium* |
| OTU_502 | 1277 | Bacilli | Bacillales | Sporolactobacillaceae | *Bacillus* |
| OTU_115 | 1306 | Betaproteobacteria | Methylophilales | Methylophilaceae | *Methylotenera* |
| OTU_631 | 1318 | Betaproteobacteria | Rhodocyclales | Rhodocyclaceae | *Methyloversatilis* |
| OTU_436 | 1235 | Clostridia | Clostridiales | Clostridiaceae | *Thermoanaerobacterium* |
| OTU_7 | 1263 | Cytophagia | Cytophagales | Cytophagaceae | *Dyadobacter* |
| OTU_4 | 1352 | Gammaproteobacteria | Pseudomonadales | Pseudomonadaceae | *Pseudomonas* |
| OTU_319 | 1234 | Bacilli | Bacillales | Staphylococcaceae | *Staphylococcus* |
| OTU_32 | 1271 | Betaproteobacteria | Burkholderiales | Comamonadaceae | *Rhodoferax* |
| OTU_90 | 1364 | Gammaproteobacteria | Pseudomonadales | Moraxellaceae | *Acinetobacter* |
| OTU_50 | 1363 | Alphaproteobacteria | Sphingomonadales | Sphingomonadaceae | *Sphingomonas* |
| OTU_10 | 1327 | Gammaproteobacteria | Xanthomonadales | Xanthomonadaceae | *Stenotrophomonas* |
| OTU_44 | 1238 | Alphaproteobacteria | Rhizobiales | Rhizobiaceae | *Rhizobium* |
| OTU_2969 | 1242 | Bacilli | Bacillales | Bacillaceae | |
| OTU_77 | 1357 | Betaproteobacteria | Burkholderiales | Comamonadaceae | |
| OTU_73 | 1344 | Gammaproteobacteria | Xanthomonadales | Xanthomonadaceae | *Xanthomonas* |
| OTU_3676 | 1332 | Gammaproteobacteria | Pseudomonadales | Pseudomonadaceae | *Pseudomonas* |
| OTU_2408 | 1374 | Gammaproteobacteria | Enterobacteriales | Enterobacteriaceae | |
| OTU_16 | 1237 | Bacilli | Bacillales | Paenibacillaceae | *Paenibacillus* |
| OTU_2272 | 1232 | Betaproteobacteria | Burkholderiales | Comamonadaceae | *Polaromonas* |
| OTU_5 | 1278 | Alphaproteobacteria | Rhizobiales | Rhizobiaceae | *Agrobacterium* |

TABLE FF

Bacterial endophytes found in the seed

| OTU_ID | SEQ ID NO: | Class | Order | Family | Genus |
|---|---|---|---|---|---|
| OTU_77 | 1357 | Betaproteobacteria | Burkholderiales | Comamonadaceae | |
| OTU_32 | 1271 | Betaproteobacteria | Burkholderiales | Comamonadaceae | *Rhodoferax* |
| OTU_2408 | 1374 | Gammaproteobacteria | Enterobacteriales | Enterobacteriaceae | |
| OTU_502 | 1277 | Bacilli | Bacillales | Sporolactobacillaceae | *Bacillus* |
| OTU_164 | 1304 | Cytophagia | Cytophagales | Cytophagaceae | *Hymenobacter* |
| OTU_3194 | 1325 | Alphaproteobacteria | Sphingomonadales | Sphingomonadaceae | *Sphingomonas* |
| OTU_604 | 1330 | Alphaproteobacteria | Sphingomonadales | Erythrobacteraceae | |
| OTU_1300 | 1275 | Deinococci | Deinococcales | Deinococcaceae | *Deinococcus* |
| OTU_436 | 1235 | Clostridia | Clostridiales | Clostridiaceae | *Thermoanaerobacterium* |
| OTU_777 | 1253 | Bacilli | Bacillales | Alicyclobacillaceae | *Alicyclobacillus* |
| OTU_290 | 1256 | [Saprospirae] | [Saprospirales] | Chitinophagaceae | *Sediminibacterium* |
| OTU_4 | 1352 | Gammaproteobacteria | Pseudomonadales | Pseudomonadaceae | *Pseudomonas* |
| OTU_2547 | 1294 | Gammaproteobacteria | Pseudomonadales | Pseudomonadaceae | |
| OTU_13 | 1340 | Bacilli | Bacillales | Bacillaceae | *Bacillus* |
| OTU_1363 | 1252 | Bacilli | Bacillales | Staphylococcaceae | |
| OTU_9 | 1291 | Gammaproteobacteria | Pseudomonadales | Pseudomonadaceae | *Pseudomonas* |
| OTU_89 | 1303 | Bacilli | Bacillales | | |
| OTU_2969 | 1242 | Bacilli | Bacillales | Bacillaceae | |
| OTU_71 | 1335 | Alphaproteobacteria | Rhizobiales | Bradyrhizobiaceae | *Bradyrhizobium* |
| OTU_272 | 1240 | Bacilli | Bacillales | Bacillaceae | *Geobacillus* |
| OTU_2272 | 1232 | Betaproteobacteria | Burkholderiales | Comamonadaceae | *Polaromonas* |
| OTU_16 | 1237 | Bacilli | Bacillales | Paenibacillaceae | *Paenibacillus* |
| OTU_1884 | 1247 | Gammaproteobacteria | Enterobacteriales | Enterobacteriaceae | *Escherichia* |
| OTU_3 | 1276 | Betaproteobacteria | Burkholderiales | Oxalobacteraceae | *Janthinobacterium* |
| OTU_1 | 1236 | Gammaproteobacteria | Enterobacteriales | Enterobacteriaceae | *Pantoea* |
| OTU_118 | 1231 | Gammaproteobacteria | Enterobacteriales | Enterobacteriaceae | *Enterobacter* |

TABLE GG

Bacterial endophytes found in the rhizosphere

| OTU_ID | SEQ ID NO: | Class | Order | Family | Genus |
|---|---|---|---|---|---|
| OTU_2460 | 1285 | Betaproteobacteria | Burkholderiales | Oxalobacteraceae | *Janthinobacterium* |
| OTU_604 | 1330 | Alphaproteobacteria | Sphingomonadales | Erythrobacteraceae | |
| OTU_173 | 1298 | Actinobacteria | Actinomycetales | Nocardioidaceae | *Aeromicrobium* |
| OTU_1004 | 1355 | Alphaproteobacteria | Ellin329 | | |
| OTU_3042 | 1356 | Alphaproteobacteria | Sphingomonadales | Sphingomonadaceae | *Novosphingobium* |
| OTU_118 | 1231 | Gammaproteobacteria | Enterobacteriales | Enterobacteriaceae | *Enterobacter* |
| OTU_2547 | 1294 | Gammaproteobacteria | Pseudomonadales | Pseudomonadaceae | |
| OTU_3760 | 1339 | Betaproteobacteria | Burkholderiales | Alcaligenaceae | *Achromobacter* |
| OTU_91 | 1267 | Deltaproteobacteria | Myxococcales | | |
| OTU_183 | 1333 | Alphaproteobacteria | Caulobacterales | Caulobacteraceae | *Mycoplana* |
| OTU_73 | 1344 | Gammaproteobacteria | Xanthomonadales | Xanthomonadaceae | *Xanthomonas* |
| OTU_16 | 1237 | Bacilli | Bacillales | Paenibacillaceae | *Paenibacillus* |
| OTU_164 | 1304 | Cytophagia | Cytophagales | Cytophagaceae | *Hymenobacter* |
| OTU_367 | 1370 | Alphaproteobacteria | Sphingomonadales | Erythrobacteraceae | |
| OTU_92 | 1305 | Deltaproteobacteria | Myxococcales | Polyangiaceae | *Chondromyces* |
| OTU_2819 | 1268 | Alphaproteobacteria | Rhizobiales | Hyphomicrobiaceae | *Devosia* |
| OTU_95 | 1308 | [Saprospirae] | [Saprospirales] | Chitinophagaceae | |
| OTU_2433 | 1295 | Alphaproteobacteria | Rhizobiales | Rhizobiaceae | |
| OTU_204 | 1353 | Alphaproteobacteria | Rhizobiales | Rhizobiaceae | *Agrobacterium* |
| OTU_9 | 1291 | Gammaproteobacteria | Pseudomonadales | Pseudomonadaceae | *Pseudomonas* |
| OTU_188 | 1365 | Actinobacteria | Actinomycetales | Microbacteriaceae | *Salinibacterium* |
| OTU_90 | 1364 | Gammaproteobacteria | Pseudomonadales | Moraxellaceae | *Acinetobacter* |
| OTU_2969 | 1242 | Bacilli | Bacillales | Bacillaceae | |
| OTU_62 | 1376 | Alphaproteobacteria | Sphingomonadales | Sphingomonadaceae | *Sphingomonas* |
| OTU_2966 | 1334 | Alphaproteobacteria | Rhizobiales | Hyphomicrobiaceae | *Devosia* |
| OTU_240 | 1324 | [Saprospirae] | [Saprospirales] | Chitinophagaceae | |
| OTU_115 | 1306 | Betaproteobacteria | Methylophilales | Methylophilaceae | *Methylotenera* |
| OTU_2272 | 1232 | Betaproteobacteria | Burkholderiales | Comamonadaceae | *Polaromonas* |
| OTU_13 | 1340 | Bacilli | Bacillales | Bacillaceae | *Bacillus* |
| OTU_141 | 1367 | Alphaproteobacteria | Sphingomonadales | Sphingomonadaceae | *Sphingomonas* |
| OTU_124 | 1368 | Alphaproteobacteria | Rhodospirillales | Rhodospirillaceae | *Azospirillum* |
| OTU_343 | 1336 | Cytophagia | Cytophagales | Cytophagaceae | *Dyadobacter* |
| OTU_44 | 1238 | Alphaproteobacteria | Rhizobiales | Rhizobiaceae | *Rhizobium* |
| OTU_57 | 1284 | Alphaproteobacteria | Rhizobiales | Hyphomicrobiaceae | *Devosia* |
| OTU_52 | 1366 | Deinococci | Deinococcales | Deinococcaceae | *Deinococcus* |
| OTU_99 | 1337 | [Saprospirae] | [Saprospirales] | Chitinophagaceae | |
| OTU_130 | 1343 | Flavobacteriia | Flavobacteriales | Flavobacteriaceae | *Flavobacterium* |
| OTU_3678 | 1359 | Gammaproteobacteria | Xanthomonadales | Xanthomonadaceae | *Rhodanobacter* |
| OTU_89 | 1303 | Bacilli | Bacillales | | |
| OTU_35 | 1375 | Bacilli | Bacillales | Paenibacillaceae | *Paenibacillus* |
| OTU_721 | 1260 | Flavobacteriia | Flavobacteriales | Flavobacteriaceae | *Flavobacterium* |
| OTU_1751 | 1279 | Gammaproteobacteria | Alteromonadales | Alteromonadaceae | *Cellvibrio* |
| OTU_1 | 1236 | Gammaproteobacteria | Enterobacteriales | Enterobacteriaceae | *Pantoea* |
| OTU_123 | 1351 | Actinobacteria | Actinomycetales | Micrococcaceae | *Arthrobacter* |
| OTU_60 | 1358 | Bacilli | Bacillales | Paenibacillaceae | *Paenibacillus* |
| OTU_3194 | 1325 | Alphaproteobacteria | Sphingomonadales | Sphingomonadaceae | *Sphingomonas* |
| OTU_86 | 1342 | Alphaproteobacteria | Caulobacterales | Caulobacteraceae | *Caulobacter* |
| OTU_148 | 1349 | Betaproteobacteria | Burkholderiales | Comamonadaceae | |
| OTU_10 | 1327 | Gammaproteobacteria | Xanthomonadales | Xanthomonadaceae | *Stenotrophomonas* |
| OTU_79 | 1290 | [Saprospirae] | [Saprospirales] | Chitinophagaceae | *Flavisolibacter* |
| OTU_779 | 1350 | Bacilli | Bacillales | Paenibacillaceae | *Paenibacillus* |
| OTU_138 | 1372 | Bacilli | Bacillales | Paenibacillaceae | *Paenibacillus* |
| OTU_3034 | 1299 | Alphaproteobacteria | Sphingomonadales | Sphingomonadaceae | *Novosphingobium* |
| OTU_49 | 1255 | Betaproteobacteria | Burkholderiales | Oxalobacteraceae | *Janthinobacterium* |
| OTU_127 | 1281 | Alphaproteobacteria | BD7-3 | | |
| OTU_67 | 1360 | Bacilli | Bacillales | Paenibacillaceae | *Paenibacillus* |
| OTU_3658 | 1274 | Alphaproteobacteria | Rhizobiales | | |
| OTU_51 | 1341 | Alphaproteobacteria | Rhizobiales | Rhizobiaceae | *Agrobacterium* |
| OTU_119 | 1259 | Sphingobacteriia | Sphingobacteriales | Sphingobacteriaceae | |
| OTU_101 | 1329 | Bacilli | Bacillales | Paenibacillaceae | |
| OTU_176 | 1328 | Alphaproteobacteria | Caulobacterales | Caulobacteraceae | *Mycoplana* |
| OTU_2846 | 1248 | Alphaproteobacteria | Rhizobiales | Rhizobiaceae | *Shinella* |
| OTU_50 | 1363 | Alphaproteobacteria | Sphingomonadales | Sphingomonadaceae | *Sphingomonas* |
| OTU_76 | 1273 | Gammaproteobacteria | Xanthomonadales | Xanthomonadaceae | *Rhodanobacter* |
| OTU_63 | 1292 | Planctomycetia | Pirellulales | Pirellulaceae | |
| OTU_54 | 1323 | Sphingobacteriia | Sphingobacteriales | | |
| OTU_134 | 1362 | Bacilli | Bacillales | Paenibacillaceae | *Paenibacillus* |
| OTU_356 | 1310 | Betaproteobacteria | Burkholderiales | Comamonadaceae | *Simplicispira* |
| OTU_53 | 1345 | Flavobacteriia | Flavobacteriales | Flavobacteriaceae | *Flavobacterium* |
| OTU_78 | 1269 | [Saprospirae] | [Saprospirales] | Chitinophagaceae | |
| OTU_66 | 1309 | Flavobacteriia | Flavobacteriales | Flavobacteriaceae | *Flavobacterium* |
| OTU_96 | 1258 | Betaproteobacteria | | | |
| OTU_41 | 1280 | Cytophagia | Cytophagales | Cytophagaceae | *Cytophaga* |
| OTU_87 | 1293 | [Saprospirae] | [Saprospirales] | Chitinophagaceae | |
| OTU_24 | 1265 | Flavobacteriia | Flavobacteriales | [Weeksellaceae] | *Chryseobacterium* |

TABLE GG-continued

Bacterial endophytes found in the rhizosphere

| OTU_ID | SEQ ID NO: | Class | Order | Family | Genus |
|---|---|---|---|---|---|
| OTU_69 | 1264 | Betaproteobacteria | IS-44 | | |
| OTU_2017 | 1286 | Sphingobacteriia | Sphingobacteriales | Sphingobacteriaceae | Pedobacter |
| OTU_139 | 1326 | Bacilli | Bacillales | | |
| OTU_264 | 1354 | Bacilli | Bacillales | Paenibacillaceae | Paenibacillus |
| OTU_178 | 1246 | [Saprospirae] | [Saprospirales] | Chitinophagaceae | |
| OTU_61 | 1300 | Cytophagia | Cytophagales | Cytophagaceae | Dyadobacter |
| OTU_81 | 1254 | [Spartobacteria] | [Chthoniobacterales] | [Chthoniobacteraceae] | |
| OTU_85 | 1243 | Alphaproteobacteria | Caulobacterales | Caulobacteraceae | Phenylobacterium |
| OTU_399 | 1270 | Verrucomicrobiae | Verrucomicrobiales | Verrucomicrobiaceae | Luteolibacter |
| OTU_108 | 1282 | Bacilli | Bacillales | Paenibacillaceae | Ammoniphilus |
| OTU_70 | 1245 | Cytophagia | Cytophagales | Cytophagaceae | |
| OTU_77 | 1357 | Betaproteobacteria | Burkholderiales | Comamonadaceae | |
| OTU_3676 | 1332 | Gammaproteobacteria | Pseudomonadales | Pseudomonadaceae | Pseudomonas |
| OTU_104 | 1338 | Bacilli | Bacillales | Paenibacillaceae | Paenibacillus |
| OTU_75 | 1287 | [Saprospirae] | [Saprospirales] | Chitinophagaceae | Flavisolibacter |
| OTU_71 | 1335 | Alphaproteobacteria | Rhizobiales | Bradyrhizobiaceae | Bradyrhizobium |
| OTU_121 | 1373 | Bacilli | Bacillales | Paenibacillaceae | Paenibacillus |
| OTU_588 | 1331 | Bacilli | Bacillales | | |
| OTU_64 | 1311 | Alphaproteobacteria | Sphingomonadales | Sphingomonadaceae | Novosphingobium |
| OTU_56 | 1266 | Deltaproteobacteria | Myxococcales | | |
| OTU_2406 | 1361 | Bacilli | Bacillales | Paenibacillaceae | Cohnella |
| OTU_3272 | 1347 | Bacilli | Bacillales | Paenibacillaceae | Brevibacillus |
| OTU_65 | 1239 | Verrucomicrobiae | Verrucomicrobiales | Verrucomicrobiaceae | Prosthecobacter |
| OTU_217 | 1301 | Bacilli | Bacillales | Planococcaceae | Paenisporosarcina |
| OTU_72 | 1251 | [Saprospirae] | [Saprospirales] | Chitinophagaceae | Sediminibacterium |
| OTU_45 | 1272 | Gammaproteobacteria | Alteromonadales | Alteromonadaceae | Cellvibrio |
| OTU_43 | 1249 | Sphingobacteriia | Sphingobacteriales | Sphingobacteriaceae | Pedobacter |
| OTU_98 | 1371 | Bacilli | Bacillales | Paenibacillaceae | Paenibacillus |
| OTU_68 | 1283 | Betaproteobacteria | Burkholderiales | Comamonadaceae | |
| OTU_29 | 1289 | Gammaproteobacteria | Xanthomonadales | Xanthomonadaceae | |
| OTU_28 | 1307 | Alphaproteobacteria | Rhizobiales | Hyphomicrobiaceae | Devosia |
| OTU_3268 | 1257 | Cytophagia | Cytophagales | Cytophagaceae | Dyadobacter |
| OTU_32 | 1271 | Betaproteobacteria | Burkholderiales | Comamonadaceae | Rhodoferax |
| OTU_23 | 1297 | [Saprospirae] | [Saprospirales] | Chitinophagaceae | Chitinophaga |
| OTU_42 | 1288 | Alphaproteobacteria | Caulobacterales | Caulobacteraceae | Asticcacaulis |
| OTU_3062 | 1302 | Bacilli | Bacillales | Paenibacillaceae | Cohnella |
| OTU_17 | 1244 | Flavobacteriia | Flavobacteriales | Flavobacteriaceae | Flavobacterium |
| OTU_34 | 1369 | Bacilli | Bacillales | Paenibacillaceae | Paenibacillus |
| OTU_15 | 1346 | Bacilli | Bacillales | Paenibacillaceae | Paenibacillus |
| OTU_37 | 1250 | Verrucomicrobiae | Verrucomicrobiales | Verrucomicrobiaceae | Luteolibacter |
| OTU_33 | 1348 | Bacilli | Bacillales | Paenibacillaceae | Brevibacillus |
| OTU_22 | 1322 | Bacilli | Bacillales | Paenibacillaceae | Cohnella |
| OTU_2408 | 1374 | Gammaproteobacteria | Enterobacteriales | Enterobacteriaceae | |
| OTU_4 | 1352 | Gammaproteobacteria | Pseudomonadales | Pseudomonadaceae | Pseudomonas |
| OTU_7 | 1263 | Cytophagia | Cytophagales | Cytophagaceae | Dyadobacter |
| OTU_18 | 1296 | Bacilli | Bacillales | Paenibacillaceae | Paenibacillus |
| OTU_5 | 1278 | Alphaproteobacteria | Rhizobiales | Rhizobiaceae | Agrobacterium |
| OTU_3 | 1276 | Betaproteobacteria | Burkholderiales | Oxalobacteraceae | Janthinobacterium |

Conclusions from Example 16

Although this experiment was done with untreated seeds rather than endoseeds, it shows that endophytes from seeds can colonize different tissues within seeds and plants, and the rhizosphere. To confirm that a particular endophyte is capable of localizing to a particular plant or seed tissue, experiments such as the one shown here or those using FISH in Examples 3 and 7.

TABLE 1

BACTERIAL GENERA

Acidobacterium, Geothrix, Holophaga, Acidimicrobium, Actinobaculum, Actinomyces, Arcanobacterium, Mobiluncus, Trueperella, Varibaculum Corynebacterium, Gordoniaceae, Mycobacterium, Nocardia, Rhodococcus, Smaragdicoccus, Micropolyspora, Frankia, Actinotelluria, Blastococcus, Geodermatophilus, Modestobacter, Angustibacter, Kineococcus, Kineosporia, Pseudokineococcus, Quadrisphaera, Glycomyces, Haloglycomyces, Stackebrandtia, Beutenbergia, Miniimonas, Salana, Serinibacter, Bogoriella, Georgenia Brevibacterium, Actinotalea, Cellulomonas, Oerskovia, Paraoerskovia, Tropheryma, Brachybacterium. Dermabacter, Devriesea, Helcobacillus, Nostocoida type II, Arsenicicoccus, Fodinibacter, Humibacillus, Humihabitans, Intrasporangium, Janibacter, Knoellia, Kribbia, Lapillicoccus, Marihabitans, Ornithinibacter, Ornithinicoccus, Ornithinimicrobium, Oryzihumus, Phycicoccus, Serinicoccus, Terrabacter, Terracoccus, Tetrasphaera, Candidatus Aquiluna, Candidatus Flaviluna, Candidatus Limnoluna, Candidatus Planktoluna, Candidatus Rhodoluna, Agreia, Agrococcus, Agromyces, Amnibacterium, Chryseoglobus, Clavibacter, Crocebacterium, Cryobacterium, Cryocola, Curtobacterium, Frigoribacterium, TABLE 1-continued

BACTERIAL GENERA

*Frondihabitans, Glaciibacter, Gulosibacter, Herbiconiux, Humibacter, Klugiella, Labedella, Leifsonia, Leucobacter, Marisediminicola, Microbacterium, Microcella, Microterricola, Mycetocola, Okibacterium, Phycicola, Plantibacter, Pseudoclavibacter, Rathayibacter, Rhodoglobus, Salinibacterium, Schumannella, Subtercola, Yonghaparkia, Zimmermannell, Acaricomes, Arthrobacter, Auritidibacter, Citricoccus, Kocuria, Micrococcus, Nesterenkonia, Renibacterium, Rothia, Sinomonas, Tersicoccus, Yaniella, Zhihengliuella, Cellulosimicrobium, Isoptericola, Myceligenerans, Promicromonospora, Xylanibacterium, Xylanimicrobium, Xylanimonas, Rarobacter, Sanguibacte, Actinaurispora, Actinocatenispora, Actinoplanes, Allocatelliglobosispora, Asanoa, Catellatospora, Catelliglobosispora, Catenuloplanes, Couchioplanes, Dactylosporangium, Hamadaea, Jishengella, Krasilnikovia, Longispora, Luedemannella, Micromonospora, Phytohabitans, Phytomonospora, Pilimelia, Planosporangium, Plantactinospora, Polymorphospora, Pseudosporangium, Rugosimonospora, Salinispora, Spirilliplanes, Solwaraspora, Verrucosispora, Virgisporangium, Wangella, Nocardia, Kribella, Propionibacterium, Actinosynnemata, Actinoalloteichus, Actinokineospora, Actinomycetospora, Actinophytocola, Actinosynnema, Alloactinosynnema, Allokutzneria, Amycolatopsis, Crossiella, Goodfellowiella, Haloechinothrix, Kibdelosporangium, Kutzneria, Lechevalieria, Lentzea, Prauseria, Prauserella, Pseudonocardia, Saccharomonospora, Saccharopolyspora, Saccharothrix, Saccharothrixopsis, Sciscionella, Streptoalloteichus, Thermobispora, Thermocrispum, Umezawaea, Yuhushiella, Kitasatospora, Streptomyces, Streptoverticillium, Nocardiopsa, Streptosporangia, Thermomonospora, Actinomadura, Actinocorallia, Spirillospora, Aeriscardovia, Alloscardovia, Bifidobacterium, Gardnerella, Metascardovia, Parascardovia, Scardovia. Atopobium, Collinsella, Coriobacterium, Cryptobacterium, Denitrobacterium, Eggerthella, Slackia, Rubrobacter, Sphaerobacter, Aquifex, Hydrogenivirga, Hydrogenobacter, Hydrogenobaculum, Thermocrinis, Hydrogenothermus, Persephonella, Sulfurihydrogenibium, Venenivibrio, Bacteroides, Acetofilamentum, Acetomicrobium, Acetothermus, Anaerorhabdus, Megamonas, Rikenella, Marinilabilia, Porphyromonas, Dysgonomonas, Prevotella, Actibacter, Aequorivita, Algibacter, Aquimarina, Arenibacter, Bergeyella, Bizionia, Capnocytophaga, Cellulophaga, Chryseobacterium, Cloacibacterium, Coenonia, Costertonia, Croceibacter, Dokdonia, Donghaeana, Elizabethkingia, Empedobacter, Epilithonimonas, Flagellimonas, Flaviramulus, Flavobacterium, Formosa, Gaetbulibacter, Galbibacter, Gelidibacter, Gillisia, Gilvibacter, Gramella, Joostella, Kaistella, Kordia, Krokinobacter, Leeuwenhoekiellam, Lutibacter, Lutimonas, Maribacter, Mariniflexile, Marixanthomonas, Mesonia, Muricauda, Myroides, Nonlabens, Ornithobacterium, Pibocella, Polaribacter, Psychroflexus, Psychroserpens, Riemerella, Robiginitalea, Salegentibacter, Salinimicrobium, Sandarakinotalea, Sediminibacter, Sediminicola, Sejongia, Spongiimonas, Stenothermobacter, Subsaxibacter, Subsaximicrobium, Tamlana, Tenacibaculum, Ulvibacter, Vitellibacter, Wautersiella, Weeksella, Winogradskyella, Yeosuana, Zeaxanthinibacter, Zhouia, Zobellia, Zunongwangia, Myroides, Psychromonas, Blattabacterium, Rhodotherma, Sphingobacterium, Pedobacter, Mucilaginibacter, Saprospira, Haliscomenobacter, Lewinella, Flexibacter, Cyclobacterium, Cytophaga, Dyadobacter, Flectobacillus, Hymenobacter, Meniscus, Microscilla, Runella, Spirosoma, Sporocytophaga, Flammeovirga, Flexithrix, Persicobacter, Thermonema, Crenothrix, Chitinophaga, Rhodothermus, Toxothrix, Chlamydia, Chlamydophila, Parachlamydia, Protochlamydia, Neochlamydia, Rhabdochlamydia, Simkania, Fritschea, Waddlia, Chlorobium, Ancalochloris, Chloroherpeton, Clathrochloris, Pelodictyon, Prostheochloris, Herpetosiphon, Chloroflexus, Oscillochloris, Chloronema, Roseiflexus, Heliothrix, Herpetosiphon, Chrysiogenes, Microcystis, Anacystis, Chondrocystis, Eucapsis, Gloeocapsa, Merismopedia, Polycystis, Camptylonemopsis, Coleodesmiopsis, Coleodesmium, Fortiea, Hassallia, Microchaete, Ophiothrix, Petalonema, Rexia, Spirirestris, Streptostemon, Tolypothrix, Anabaena, Anabaenopsis, Aphanizomenon, Aulosira, Cylindrospermopsis, Cylindrospermum, Loefgrenia, Nodularia, Nostoc, Wollea, Amphithrix, Calothrix, Dichothrix, Diplotrichia, Gaillardotella, Gardnerula, Gloeotrichia, Gloiotrichia, Heteractis, Inomeria, Isactis, Mastigonema, Montanoa, Primorivularia, Rivularia, Rivulariopsis, Sacconema, Tildenia, Zonotrichites, Arthrosiphon, Arthrosiphon, Brasilonema, Desmonema, Diplocolon, Drilosiphon, Drilosiphon, Eoplectonema, Kyrtuthrix, Paraortonella, Scytonema, Scytonematopsis, Stigonemata, Deferribacter, Denitrovibrio, Flexistipes, Geovibrio, Deinococcus, Thermus, Meiothermus, Marinithermus, Oceanithermus, Vulcanithermus, Dictyoglomus, Fibrobacter, Alicyclobacillus, Pasteuria, Sulfobacillus, Alkalibacillus, Amphibacillus, Anoxybacillus, Bacillus, Caldalkalibacillus, Cerasibacillus, Exiguobacterium, Filobacillus, Geobacillus, Gracilibacillus, Halalkalibacillus, Halobacillus, Halolactibacillus, Jeotgalibacillus, Lentibacillus, Lysinibacillusm, Marinibacillus, Oceanobacillus, Ornithinibacillus, Paraliobacillus, Paucisalibacillus, Pelagibacillus, Piscibacillus, Pontibacillus, Saccharococcus, Salibacillus, Salimicrobium, Salinibacillus, Salirhabdus, Salsuginibacillus, Tenuibacillus, Terribacillus, Thalassobacillus, Ureibacillus, Virgibacillus, Vulcanibacillus, Caryophanon, Brochothrix, Listeria, Paenibacillus, Ammoniphilus, Aneurinibacillus, Brevibacillus, Oxalophagus, Thermicanus, Thermobacillus, Filibacter, Kurthia, Planomicrobium, Sporosarcina, Sinobaca, Sporolactobacillus, Tuberibacillus, Staphylococcus, Gemella, Jeotgalicoccus, Macrococcus, Salinicoccus, Nosocomiicoccus, Shimazuella, Thermoactinomyces, Turicibacter, Acidaminococcus, Acetonema, Allisonella Anaeroarcus Anaeroglobus, Anaeromusa, Anaerosinus, Anaerospora, Anaerovibrio, Centipeda, Dendrosporobacter, Desulfosporomusa, Dialister, Megamonas, Megasphaera, Rogosa, Mitsuokella, Negativicoccus, Pectinatus, Pelosinus, Propionispira, Propionispora, Psychrosinus, Quinella, Schwartzia, Selenomonas, Sporolituus, Sporomusa, Thermosinus, Veillonella, Zymophilus, Phascolarctobacterium, Succiniclasticum, Succinispira, Acetanaerobacterium, Acetivibrio, Acidaminobacter, Alkaliphilus, Anaerobacter, Anaerotruncus, Anoxynatronum, Bryantella, Butyricicoccus, Caldanaerocella, Caloramator, Caloranaerobacter, Caminicella, Candidatus Arthromitus, Clostridium, Coprobacillus, Dorea, Ethanologenbacterium, Faecalibacterium, Garciella, Guggenheimella, Hespellia, Linmingia, Natronincola, Oxobacter, Parasporobacterium, Sarcina, Soehngenia, Sporobacter, Subdoligranulum, Tepidibacter, Tepidimicrobium, Thermobrachium, Thermohalobacter, Tindallia, Acetobacterium, Alkalibaculum, Anaerofustis, Anaerovorax, Eubacterium, Mogibacterium, Pseudoramibacter, Candidatus Helioclostridium, Heliobacterium, Heliobacillus, Heliophilum, Heliorestis, Lachnospira, Anaerospora, Carboxydothermus, Cryptanaerobacter, Dehalobacter, Desulfitobacterium, Desulfonispora, Desulfosporosinus,*

TABLE 1-continued

BACTERIAL GENERA

*Desulfotomaculum, Pelotomaculum, Peptococcus, Syntrophobotulus, Thermincola, Thermoterrabacterium, Filifactor, Finegoldia, Fusibacter, Helcococcus, Peptostreptococcus, Tissierella, Syntrophomonad, Halanaerobia,* Halobacteroidaceae, *Thermoanaerobacteria, Coprothermobacter Thermodesulfobium, Hepatoplasma* (Candidatus), *Mycoplasma, Ureaplasma, Entomoplasma, Mesoplasma, Spiroplasma, Anaeroplasma, Asteroleplasma, Erysipelothrix, Holdemania, Acholeplasma, Phytoplasma* (Candidatus), *Fusobacterium, Gemmatimonas, Nitrospira, Gemmata, Isosphaera, Pirellula, Planctomyces, Brocadia* (candidatus), *Kuenenia* (candidatus), *Scalindua* (candidatus), *Anammoxoglobus* (candidatus), *Jettenia* (candidatus), *Asticcacaulis, Brevundimonas, Caulobacter, Phenylobacterium, Kordiimonas, Parvularcula, Aurantimonas, Fulvimarina, Bartonella, Beijerinckia, Chelatococcus, Derxia, Methylocella, Afipia, Agromonas, Blastobacter, Bosea, Bradyrhizobium, Nitrobacter, Oligotropha, Photorhizobium, Rhodoblastus, Rhodopseudomonas, Brucella, Mycoplana, Ochrobactrum, Ancalomicrobium, Ancylobacter, Angulomicrobium, Aquabacter, Azorhizobium, Blastochloris, Devosia, Dichotomicrobium, Filomicrobium, Gemmiger, Hyphomicrobium, Labrys, Methylorhabdus, Pedomicrobium, Prosthecomicrobium, Rhodomicrobium, Rhodoplanes, Seliberia, Starkeya, Xanthobacter, Methylobacterium, Microvirga, Protomonas, Roseomonas, Methylocystis, Methylosinus, Methylopila, Aminobacter, Aquamicrobium, Defluvibacter, Hoeflea, Mesorhizobium, Nitratireductor, Parvibaculum, Phyllobacterium, Pseudaminobacter, Agrobacterium, Rhizobium, Sinorhizobium, Liberibacter* (candidatus), *Rhodobium, Ahrensia, Albidovulum, Amaricoccus, Antarctobacter, Catellibacterium, Citreicella, Dinoroseobacter, Haematobacter, Jannaschia, Ketogulonicigenium, Leisingera, Loktanella, Maribius, Marinosulfonomonas, Marinovum, Maritimibacter, Methylarcula, Nereida, Oceanibulbus, Oceanicola, Octadecabacter, Palleronia, Pannonibacter, Paracoccus, Phaeobacter, Pseudorhodobacter, Pseudovibrio, Rhodobaca, Rhodobacter, Rhodothalassium, Rhodovulum, Roseibacterium, Roseibium, Roseicyclus, Roseinatronobacter, Roseisalinus, Roseivivax, Roseobacter, Roseovarius, Rubrimonas, Ruegeria, Sagittula, Salipiger, Silicibacter, Staleya, Stappia, Sulfitobacter, Tetracoccus, Thalassobacter, Thalassobius, Thioclava, Yangia, Azospirillum, Dechlorospirillum, Defluvicoccus, Inquilinus, Magnetospirillum, Phaeospirillum, Rhodocista, Rhodospira, Rhodospirillum, Rhodovibrio, Roseospira, Skermanella, Thalassospira, Tistrella, Acetobacter, Acidicaldus, Acidiphilium, Acidisphaera, Acidocella, Acidomonas, Asaia, Belnapia, Craurococcus, Gluconacetobacter, Gluconobacter, Kozakia, Leahibacter, Muricoccus, Neoasaia, Oleomonas, Paracraurococcus, Rhodopila, Roseococcus, Rubritepida, Saccharibacter, Stella, Swaminathania, Teichococcus, Zavarzinia, Rickettsia, Orientia, Wolbachia, Aegyptianella, Anaplasma, Cowdria, Ehrlichia, Neorickettsia, Caedibacter, Holospora, Lyticum, Odyssella, Symbiotes, Tectibacter, Blastomonas, Citromicrobium, Erythrobacter, Erythromicrobium, Kaistobacter, Lutibacterium, Novosphingobium, Porphyrobacter, Sandaracinobacter, Sphingobium, Sphingomonas, Sphingopyxis, Zymomonas, Achromobacter, Alcaligenes, Bordetella, Pelistega, Sutterella, Taylorella, Burkholderia, Chitinimonas, Cupriavidus, Lautropia, Limnobacter, Pandoraea, Paucimonas, Polynucleobacter, Ralstonia, Thermothrix, Acidovorax, Aquabacterium, Brachymonas, Comamonas, Curvibacter, Delftia, Hydrogenophaga, Ideonella, Leptothrix, Limnohabitans, Pelomonas, Polaromonas, Rhodoferax, Roseateles, Sphaerotilus, Tepidimonas, Thiomonas, Variovorax, Collimonas, Duganella, Herbaspirillum, Herminiimonas, Janthinospirillum, Massilia, Naxibacter, Oxalobacter, Oxalicibacterium, Telluria, Hydrogenophilus, Tepidiphilus, Methylophilus, Methylobacillus, Methylovorax, Alysiella, Aquaspirillum, Catenococcus, Chromobacterium, Eikenella, Formivibrio, Iodobacter, Kingella, Microvirgula, Neisseria, Prolinoborus, Simonsiella, Vitreoscilla, Vogesella, Nitrosomonas, Nitrosospira, Gallionella, Spirillum, Azoarcus, Azonexus, Azospira, Azovibrio, Dechloromonas, Ferribacterium, Petrobacter, Propionivibrio, Rhodocyclus, Sterolibacterium, Thauera, Zoogloea, Acidithiobacillus, Thermithiobacillus, Aeromonas, Tolumonas, Anerobiospirillum, Ruminobacter, Succinimonas, Succinivibrio, Aestuariibacter, Agarivorans, Aliagarivorans, Alishewanella, Alteromonas, Bowmanella, Catenovulum, Glaciecola, Haliea, Marinimicrobium, Marinobacter, Marinobacterium, Microbulbifer, Saccharophagus, Salinimonas, Celerinatantimonads, Colwellia, Thalassomonas, Ferrimonas, Idiomarina, Moritella, Pseudoalteromonas, Algicola, Psychromonas, Shewanella, Cardiobacterium, Dichelobacter, Suttonella, Allochromatium, Amoebobacter, Chromatium, Halochromatium, Isochromatium, Lamprobacter, Lamprocystis, Marichromatium, Nitrosococcus, Pfennigia, Rhabdochromatium, Rheinheimera, Thermochromatium, Thioalkalicoccus, Thiobaca, Thiocapsa, Thiococcus, Thiocystis, Thiodictyon, Thioflavicoccus, Thiohalocapsa, Thiolamprovum, Thiopedia, Thiophaeococcus, Thiorhodococcus, Thiorhodovibrio, Thiospirillum, Alkalilimnicola, Alkalispirillum, Aquisalimonas, Arhodomonas, Ectothiorhodosinus, Ectothiorhodospira, Halorhodospira, Natronocella, Nitrococcus, Thioalkalispira, Thioalkalivibrio, Thiohalospira, Thiorhodospira, Granulosicoccus, Halothiobacillus, Thioalkalispira, Alishewanella, Alterococcus, Aquamonas, Aranicola, Arsenophonus, Azotivirga, Blochmannia, Brenneria, Buchnera, Budvicia, Buttiauxella, Cedecea, Citrobacter, Cronobacter, Dickeya, Edwardsiella, Enterobacter, Erwinia, Escherichia, Ewingella, Grimontella, Hafnia, Hamiltonella, Klebsiella, Kluyvera, Leclercia, Leminorella, Moellerella, Morganella, Obesumbacterium, Pantoea, Pectobacterium, Candidatus Phlomobacter, Photorhabdus, Plesiomonas, Pragia, Proteus, Providencia, Rahnella, Regiella, Raoultella, Salmonella, Samsonia, Serratia, Shigella, Sodalis, Tatumella, Trabulsiella, Wigglesworthia, XenorhabdusYersinia, Yokenella, Coxiella, Legionells, Crenothrix, Chitinophaga, Rhodothermus, Toxothrix, Methylomonas, Methylobacter, Methylococcus, Methylomicrobium, Methylosphaera, Methylocaldum, Alcanivorax, Uruburuia, Hahella, Carnimonas, Chromohalobacter, Cobetia, Halomonas, Portiera, Zymobacter, Litocolum, Balneatrix, Fundibacter, Marinomonas, Marinospirillum, Neptunomonas, Oceanospirillum, Oleiphilum, Saccharospirillum, Actinobacillus, Aggregatibacter, Haemophilus, Lonepinella, Pasteurella, Mannheimia, Phocoenobacter, Acinetobacter, Alkanindiges, Branhamella, Enhydrobacter, Moraxella, Paraperlucidibaca, Perlucidibaca, Psychrobacter, Azomonas, Azomonotrichon, Azorhizophilus, Azotobacter, Cellvibrio, Mesophilobacter, Pseudomonas, Rhizobacter, Rugamonas, Serpens, Salinisphaer, Francisella, Cycloclasticus, Hydrogenovibrio, Methylophaga, Piscirickettsia, Thioalkalimicrobium, Thiomicrospira, Achromatium, Beggiatoa, Leucothrix, Macromonas, Thiobacterium, Thiomargarita, Thioploca, Thiospira, Thiothrix, Aliivibrio, Allomonas, Beneckea, Enhydrobacter, Listonella, Lucibacterium, Photobacterium, Salinivibrio, Vibrio, Sinobactera,*

TABLE 1-continued

BACTERIAL GENERA

*Frateuria, Luteimonas, Lysobacter, Nevskia, Pseudoxanthomonas, Rhodanobacter, Stenotrophomonas, Xanthomonas, Xylella, Algicola, Colwellia, Thalassomonas, Shewanella, Bdellovibrio, Micavibrio, Vampirovibrio,* Desulfobacteraceae, Desulfobulbaceae, Desulfoarculaceae, *Desulfovibrio, Bilophila, Lawsonia, Desulfohalobium, Desulfomonas, Desulfonatronovibrio, Desulfomicrobium, Desulfonatronum, Desulfurella,* Hippe, *Desulfuromonas, Desulfuromusa, Malonomonas, Pelobacter, Geoalkalibacter, Geobacter, Mixococcus, Stigmatella, Sorangium, Desulfacinum, Desulforhabdus, Syntrophobacter, Syntrophothermus, Thermaerobacter, Thermodesulforhabdus, Syntrophus, Smithella, Campylobacter, Arcobacter, Sulfurospirillum, Thiovulum, Helicobacter, Wolinella, Caminibacter, Lebetimonas, Nautilia, Nitratifractor, Nitratiruptor, Thioreductor, Borrelia, Brevinema, Cristispira, Spirochaeta, Spironema, Treponema, Brachyspira, Leptospira, Leptonema, Thermodesulfobacterium, Thermatoga, Verrucomicrobium, Prosthecobacter,* and *Akkermansia.*

TABLE 2

BACTERIAL ENDOPHYTES

*Acetobacter* sp.[1]
*Achromobacter* sp.[1]
*Achromobacter spanius*[2]
*Achromobacter xylosoxidans*[3]
*Acidithiobacillus albertensis*[3]
*Acidovorax facilis*[3]
*Acidovorax* sp.[4]
*Acidovorax* sp.[1]
*Acidovorax temperans*[3]
*Acidovoraz temperans*[3]
*Acinetobacter baumannii*[1]
*Acinetobacter baumannii*[3]
*Acinetobacter baumannii* ATCC 17978 (ABO13540)[5]
*Acinetobacter baumannii* ATCC 17978 (ABO13540)[5]
*Acinetobacter beijerinckii*[2]
*Acinetobacter beijerinckii*[3]
*Acinetobacter calcoaceticus*[3]
*Acinetobacter johnsonii*[3]
*Acinetobacter junii*[3]
*Acinetobacter kyonggiensis*[3]
*Acinetobacter lwoffii*[3]
*Acinetobacter radioresistens*[3]
*Acinetobacter schindleri*[3]
*Acinetobacter* sp.[3]
*Acinetobacter* sp.[1]
*Actinobacter* sp.[6]
*Actinomyces* sp.[1]
*Aerobacter cloaceae*[1]
*Aerococcus urinaeequi*[3]
*Aeromonas hydrophila*[5]
*Arthrobacter ramosus*[7]
*Arthrobacter* sp.[1]
*Arthrobacter ureafaciens*[1]
*Atopobium rimae* ATCC 49626, ref|ZP_03568303.1|[5]
*Azoarcus* sp. strain BH72[8]
*Azoarcus* spp.[9]
*Azobacter chroococcum*[1]
*Azorhizobium caulinodans*[5]
*Azospirillum brasilense*[1]
*Azospirillum zea*[7]
*Azotobacter chroococcum*[1]
*Bacillus alclophialus*[1]
*Bacillus anthracis*[3]
*Bacillus aryabhattai*[3]
*Bacillus asahai*[7]
*Bacillus brevis*[1]
*Bacillus cereus*[5]
*Bacillus cereus*[10]
*Bacillus cereus* 03BB108, ref|ZP_03110815.1|[5]
*Bacillus circulans*[7]
*Bacillus endophyticus*[1]
*Bacillus licheniformis*[11]
*Bacillus megaterium*[1]
*Bacillus mojavensis*[1]
*Bacillus novalisa*[1]
*Bacillus pasteurii*[1]
*Bacillus polymyxa*[1]
*Bacillus psychrosaccharolyticus*[2]

TABLE 2-continued

BACTERIAL ENDOPHYTES

*Bacillus pumilus*[1]
*Bacillus pumilus*[4]
*Bacillus pumilus* SAFR-032, ref|YP_001486461.1|[5]
*Bacillus simplex*[11]
*Bacillus* sp.[1]
*Bacillus* sp. SG-1 (EDL63514)[5]
*Bacillus* sp. SG-1 (EDL63514)[5]
*Bacillus sphaericus*[1]
*Bacillus stratosphericus*[3]
*Bacillus subtilis*[1]
*Bacillus subtilis*[4]
*Bdellovibrio bacteriovorus*[3]
*Beijerinckia indica* subsp. *indica* ATCC 9039 (ACB96131)[5]
*Beijerinckia indica* subsp. *indica* ATCC 9039 (ACB96131)[5]
*Bifidobacterium adolescentis*[5]
*Bifidobacterium adolescentis* ATCC 15703, ref|YP_909356.1|[5]
*Bifidobacterium longum*[5]
*Bifidobacterium longum* DJO10A, ref|ZP_00120992.1|[5]
*Blautia hansenii* DSM 20583, ref|ZP_03548131.1|[5]
*Bordetella* sp.[1]
*Bosea vestrisii*[3]
*Bradyrhizobium japonicum*[7]
*Bradyrhizobium japonicum* USDA 110 (BAC53039)[5]
*Bradyrhizobium japonicum* USDA 110 (BAC53039)[5]
*Bradyrhizobium japonicum* USDA 110, ref|NP_769684.1|[5]
*Bradyrhizobium pachyrhizi*[3]
*Bradyrhizobium* sp. BTAi1, ref|YP_001220569.1|[5]
*Bradyrhizobium* sp. ORS278, ref|YP_001208056.1|[5]
*Brevibacillus agri*[7]
*Brevibacterium frigoritolerans*[3]
*Brevibacterium incertum*[3]
*Brevundimonas diminuta*[3]
*Brevundimonas naejangsanensis*[3]
*Brevundimonas* sp.[12]
*Brevundimonas* sp.[3]
*Burkholderia cepacia*[1]
*Burkholderia diffusa*[3]
*Burkholderia fungorum*[7]
*Burkholderia ginsengisoli*[3]
*Burkholderia gladioli*[3]
*Burkholderia gladioli*[1]
*Burkholderia phymatum* STM815, ref|YP_001857126.1|[5]
*Burkholderia phytofirmans*[13]
*Burkholderia phytofirmans*[7]
*Burkholderia phytofirmans*[3]
*Burkholderia pickettii*[1]
*Burkholderia plantarii*[3]
*Burkholderia* sp.[3]
*Burkholderia vietnamiensis*[5]
*Candidatus Rhizobium*[3]
*Capnocytophaga* sp.[1]
*Caulobacter crescentus* NA1000 (ACL97137)[5]
*Caulobacter crescentus* NA1000 (ACL97137)[5]
*Caulobacter* sp.[1]
*Cedecea davisae*[3]
*Cellulomonas denverensis*[7]
*Cellulomonas* sp.[1]
*Cellvibrio japonicus* Ueda107 (ACE84205)[5]

TABLE 2-continued

| BACTERIAL ENDOPHYTES |
|---|
| *Cellvibrio japonicus* Ueda107 (ACE84205)[5] |
| *Cellvibrio mixtus*[3] |
| *Cellvibrio* sp.[14] |
| *Chitinophaga pinensis* DSM 2588, ref\|ZP_04357604.1\|[5] |
| *Chlorobium tepidum* TLS (AAM72443)[5] |
| *Chlorobium tepidum* TLS (AAM72443)[5] |
| *Chryseobacterium hominis*[3] |
| *Chryseobacterium* sp. [1] |
| *Chryseobacterium* sp.[3] |
| *Citrobacter braakii*[7] |
| *Citrobacter freundii*[7] |
| *Citrobacter koseri*[5] |
| *Citrobacter koseri* ATCC BAA-895, ref\|YP_001452611.1\|[5] |
| *Citrobacter koseri* ATCC BAA-895, ref\|YP_001455544.1\|[5] |
| *Citrobacter* sp. [1] |
| *Clavibacter michiganensis*[12] |
| *Clostridium acetobutylicum*[7] |
| *Clostridium acetobutylicum* ATCC 824, ref\|NP_349544.1\|[5] |
| *Clostridium beijerinckii*[7] |
| *Clostridium beijerinckii* NCIMB 8052, ref\|YP_001308375.1\|[5] |
| *Clostridium botulinum* B1 str. Okra, ref\|YP_001780987.1\|[5] |
| *Clostridium butyricum* 5521, ref\|ZP_02626830.2\|[5] |
| *Clostridium leptum* DSM 753, ref\|ZP_02079097.1\|[5] |
| *Clostridium ramosum* DSM 1402, ref\|ZP_02429609.1\|[5] |
| *Clostridium* sp. SS2/1, ref\|ZP_02439410.1\|[5] |
| *Clostridium* spp.[15] |
| *Cohnella yongneupensis*[11] |
| *Collinsella aerofaciens*[5] |
| *Collinsella aerofaciens* ATCC 25986, ref\|ZP_01773331.1\|[5] |
| *Colwellia psychrerythraea* 34H, ref\|YP_271045.1\|[5] |
| *Comamonas* sp. [1] |
| *Comanomonas testosteroni* [1] |
| *Coryebacterium* sp. [1] |
| *Corynebacterium pseudogenitalium*[3] |
| *Corynebacterium* sp.[3] |
| *Cronobacter turicensis*[3] |
| *Cupriavidus campinensis*[11] |
| *Cupriavidus gilardii*[3] |
| *Curtobacterium citrenum* [1] |
| *Curtobacterium citreum*[2] |
| *Curtobacterium flaccumfaciens*[6] |
| *Curtobacterium flaccumfaciens*[4] |
| *Curtobacterium flaccumfaciens* [1] |
| *Curtobacterium herbarum*[2] |
| *Curtobacterium leteum* [1] |
| *Curtobacterium* sp. [1] |
| *Curvibacter gracilis*[3] |
| *Cyanothece* sp. PCC 7425, ref\|YP_002483742.1\|[5] |
| *Deinococcus ficus*[2] |
| *Deinococcus geothermalis* DSM 11300 (ABF44161)[5] |
| *Deinococcus geothermalis* DSM 11300 (ABF44161)[5] |
| *Deinococcus grandis*[7] |
| *Deleya* sp. [1] |
| *Delftia acidovorans*[11] |
| *Desemzia incerta*[3] |
| *Devosia insulae*[3] |
| *Devosia riboflavina*[3] |
| *Dokdonella* sp.[3] |
| *Dyella ginsengisoli*[2] |
| *Enhydrobacter aerosaccus*[3] |
| *Enterobacter* sp. [1] |
| *Enterobacter aerogenes*[7] |
| *Enterobacter agglomerans* [1] |
| *Enterobacter amnigenus*[3] |
| *Enterobacter arachidis*[2] |
| *Enterobacter asburiae*[7] |
| *Enterobacter cancerogenus*[3] |
| *Enterobacter cloacae* [1] |
| *Enterobacter cloacae* subsp. *cloacae*[2] |
| *Enterobacter dissolvens*[3] |
| *Enterobacter hormaechei*[7] |
| *Enterobacter intermedius*[16] |
| *Enterobacter ludwigii*[11] |
| *Enterobacter nimipressuralis*[3] |
| *Enterobacter oryzae*[3] |
| *Enterobacter sakazakii* [1] |
| *Enterobacter sakazakii* ATCC BAA-894, ref\|YP_001436701.1\|[5] |
| *Enterobacter* sp.[3] |
| *Enterobacter* sp.[16] |
| *Enterobacter* sp. 638 (ABP60470)[5] |
| *Enterobacter* sp. 638 (ABP60470)[5] |
| *Enterococcus gallinarum*[7] |
| *Erwinia aphidicola*[3] |
| *Erwinia chrysanthemi*[5] |
| *Erwinia cypripedi*[3] |
| *Erwinia persicina*[17] |
| *Erwinia* sp. [1] |
| *Erwinia*-like sp. [1] |
| *Escherichia coli*[2] |
| *Escherichia coli*[3] |
| *Escherichia coli* [1] |
| *Escherichia hermannii*[3] |
| *Escherichia* sp. [1] |
| *Ewingella americana*[17] |
| *Finegoldia magna*[3] |
| *Flavisolibacter ginsengiterrae*[3] |
| *Flavobacteriales bacterium* HTCC2170, ref\|ZP_01105756.1\|[5] |
| *Flavobacterium aquatile*[3] |
| *Flavobacterium degerlachei*[3] |
| *Flavobacterium johnsoniae*[2] |
| *Flavobacterium johnsoniae*[3] |
| *Flavobacterium mizutaii*[3] |
| *Flavobacterium* sp. [1] |
| *Frigoribacterium faeni*[2] |
| *Frigoribacterium* sp.[12] |
| *Gemmata obscuriglobus* UQM 2246, ref\|ZP_02731927.1\|[5] |
| *Geobacter* sp. FRC-32, ref\|YP_002535550.1\|[5] |
| *Georgfuchsia toluolica*[3] |
| *Gluconacetobacter diazothrophicus* [1] |
| *Hafnia alvei*[7] |
| *Halomonas daqingensis*[3] |
| *Herbaspirillum rubrisubalbicans*[11] |
| *Herbaspirillum rubrisubalvicans*[2] |
| *Herbaspirillum seropedicae*[5] |
| *Herbaspirillum* sp. [1] |
| *Herpetosiphon aurantiacus* ATCC 23779 (ABX02684)[5] |
| *Herpetosiphon aurantiacus* ATCC 23779 (ABX02684)[5] |
| *Herpetosiphon aurantiacus* ATCC 23779, ref\|YP_001545781.1\|[5] |
| *Hydrocarboniphaga effusa*[3] |
| *Hydrogenophaga pseudoflava* [1] |
| *Hydrogenophaga* sp. [1] |
| *Janthinobacterium* sp. IC161[11] |
| *Kingella denitrificans* [1] |
| *Kingella kingae* [1] |
| *Klebsiella oxytoca* [1] |
| *Klebsiella pneumoniae* [1] |
| *Klebsiella pneumoniae*[7] |
| *Klebsiella pneumoniae*[3] |
| *Klebsiella pneumoniae* 342 (ACI07402)[5] |
| *Klebsiella pneumoniae* 342 (ACI07402)[5] |
| *Klebsiella* sp. [1] |
| *Klebsiella variicola*[3] |
| *Kluyvera* sp. [1] |
| *Kocuria rosea*[3] |
| *Kordia algicida* OT-1, ref\|ZP_02160368.1\|[5] |
| *Kytococcus sedentarius*[11] |
| *Lactobacillus iners*[3] |
| *Lactobacillus* sp. [1] |
| *Leclercia adecarboxylata*[3] |
| *Lentzea flaviverrucosa*[3] |
| *Leptospirillum* sp.[5] |
| *Leptospirillum* sp. Group II '5-way CG', gb\|EDZ37921.1\|[5] |
| *Leuconostoc* sp. [1] |
| *Limnobacter thiooxidans*[3] |
| *Luteibacter anthropi*[3] |
| *Luteimonas aestuarii*[3] |
| *Lysobacter enzymogenes*[11] |
| *marine gamma proteobacterium* HTCC2148, gb\|EEB80372.1\|[5] |
| *Massilia aerolata*[3] |
| *Massilia albidiflava*[3] |
| *Massilia* sp.[3] |
| *Mesorhizobium loti* MAFF303099 (BAB54059)[5] |
| *Mesorhizobium loti* MAFF303099 (BAB54059)[5] |
| *Mesorhizobium* sp. GWS-SE-H103[11] |
| *Mesorhizobium tianshanense*, gb\|ACF28618.1\|[5] |
| *Methanospirillum hungatei* JF-1, ref\|YP_502123.1\|[5] |

TABLE 2-continued

BACTERIAL ENDOPHYTES

Methylibium aquaticum[3]
Methylobacterium aquaticum[4]
Bacterial endophytesReference
Methylobacterium brachiatum[7]
Methylobacterium extorquens, gb|ABI17430.1|[5]
Methylobacterium nodulans ORS 2060 (ACL62186)[5]
Methylobacterium nodulans ORS 2060 (ACL62186)[5]
Methylobacterium oryzae[11]
Methylobacterium platani[3]
Methylobacterium radiotolerans[7]
Methylobacterium rhodesianum[3]
Methylobacterium sp. [1]
Methylobacterium zatmanii [1]
Methylococcus capsulatus str. Bath (AAU91441)[5]
Methylococcus capsulatus str. Bath (AAU91441)[5]
Methylophilus methylotrophus[3]
Microbacterium arborescens[11]
Microbacterium binotii[11]
Microbacterium hominis[11]
Microbacterium imperiale [1]
Microbacterium oleivorans[2]
Microbacterium oxydans[6]
Microbacterium takaoensis[11]
Microbacterium testaceum[11]
Microbacterium trichotecenolyticum[11]
Microbacterium trichothecenolyticum[11]
Micrococcus luteus[7]
Micrococcus luteus[6]
Micrococcus luteus[4]
Micrococcus sp. [1]
Micrococcus varians [1]
Microscilla marina ATCC 23134, ref|ZP_01688989.1|[5]
Microvirga aerilata[3]
Microvirga aerophilus[3]
Moraxella acinetobacter [1]
Moraxella sp.[6]
Mycobacterium abscessus[2]
Mycobacterium cosmeticum[11]
Mycobacterium smegmatis str. MC2 155 (ABK70727)[5]
Mycobacterium smegmatis str. MC2 155 (ABK70727)[5]
Mycobacterium vanbaalenii[5]
Myxococcus xanthus DK 1622, ref|YP_629504.1|[5]
Neisseria meningitidis[2]
Nitrobacter hamburgensis X14 (ABE64325)[5]
Nitrobacter hamburgensis X14 (ABE64325)[5]
Nitrobacter winogradskyi Nb-255, ref|YP_318852.1|[5]
Nocardia farcinica IFM 10152 (BAD60391)[5]
Nocardia farcinica IFM 10152 (BAD60391)[5]
Nocardia ignorata[3]
Nocardia soli[3]
Nocardia sp. [1]
Nostoc punctiforme PCC 73102, ref|YP_001869999.1|[5]
Nostoc sp. PCC 7120, ref|NP_484408.1|[5]
Oceanibaculum pacificum[3]
Ochrobaceterium anthropi [1]
Ochrobactrum grignonense[2]
Ochrobactrum pseudogrignonense[3]
Ochrobactrum tritici[2]
Oxalophagus oxalicus[3]
Paenibacillus agarexedens[11]
Paenibacillus amylolyticus[4]
Paenibacillus barcinonensis[11]
Paenibacillus caespitis[7]
Paenibacillus chondroitinus[11]
Paenibacillus daejeonensis[3]
Paenibacillus humicus[2]
Paenibacillus macerans [1]
Paenibacillus nanensis[3]
Paenibacillus phyllosphaerae[11]
Paenibacillus polymyxa[7]
Paenibacillus ruminocola[7]
Paenibacillus sp.[6]
Paenibacillus sp. [1]
Paenibacillus sp. JDR-2 (EDS55035)[5]
Paenibacillus sp. JDR-2 (EDS55035)[5]
Paenibacillus taejonensis[3]
Paenibacillus xylanilyticus[3]
Pandoraea sputorum[11]
Pandoraea sputorum[3]
Pantoea agglomerans[2]
Pantoea agglomerans[3]
Pantoea agglomerans [1]
Pantoea ananatis[7]
Pantoea ananatis[10]
Pantoea ananatis[4]
Pantoea anthophila[3]
Pantoea dispersa[7]
Pantoea dispersa[3]
Pantoea eucalypti[3]
Pantoea sp. [1]
Pasteurella sp. [1]
Pedobacter panaciterrae[11]
Pelomonas puraquae[3]
Perlucidibaca piscinae[3]
Phenylobacterium zucineum[5]
Phenylobacterium zucineum HLK1, ref|YP_002128524.1|[5]
Photobacterium sp. [1]
Phyllobacterium sp. [1]
Phytoplasma vitis[17]
Planomicrobium glaciei[3]
Plantibacterflavus[2]
Plantibacter sp.[6]
Polaribacter sp. 3-17, gb|ABS01329.1|[5]
Ponticoccus gilvus[6]
Propionibacterium acnes[3]
Propioniciclava tarda[3]
Providencia rustigianii[3]
Providencia sp. [1]
Pseudoalteromonas sp.[5]
Pseudoalteromonas sp. AS-11, dbj|BAB61726.1|[5]
Pseudomonas £uorescens[14]
Pseudomonas aeruginosa PA7 (ABR85743)[5]
Pseudomonas aeruginosa PA7 (ABR85743)[5]
Pseudomonas aureofaciens [1]
Pseudomonas chloroaphis [1]
Pseudomonas cichorii [1]
Pseudomonas citronellolis [1]
Pseudomonas corrugata [1]
Pseudomonas fluorescens [1]
Pseudomonas fluorescens Pf0-1 (ABA76623)[5]
Pseudomonas fluorescens Pf0-1 (ABA76623)[5]
Pseudomonas fragi [1]
Pseudomonas fulva [1]
Pseudomonas hibiscicola[3]
Pseudomonas lanceolata[3]
Pseudomonas mendocina[5]
Pseudomonas moraviensis [1]
Pseudomonas oleovarans[11]
Pseudomonas oryzihabitans[2]
Pseudomonas oryzihabitans[3]
Pseudomonas oryzihabitans[7]
Pseudomonas plecoglossicida[3]
Pseudomonas poae[3]
Pseudomonas protegens[2]
Pseudomonas putida [1]
Pseudomonas putida[2]
Pseudomonas putida F1 (ABQ77146)[5]
Pseudomonas putida F1 (ABQ77146)[5]
Pseudomonas putida W619 (ACA72735)[5]
Pseudomonas rhodesiae[12]
Pseudomonas saccharophila [1]
Pseudomonas sp. [1]
Pseudomonas sp.[3]
Pseudomonas stamineaj [1]
Pseudomonas stutzeri[3]
Pseudomonas stutzeri [1]
Pseudomonas syringae [1]
Pseudomonas syringae pv. phaseolicola 1448A (AAZ34722)[5]
Pseudomonas tolaasii [1]
Pseudonocardia aurantiaca[3]
Pseudoxanthomonas kaohsiungensis[3]
Psychrobacter immobilis [1]
Psychrobacter pulmonis[3]
Psychrobacter sp. [1]
Psychrobacter urativorans[3]
Psychroflexus torquis ATCC 700755, ref|ZP_01254843.1|[5]

TABLE 2-continued

BACTERIAL ENDOPHYTES

Rahnella aquatilis[18]
Ralstonia japonicum [1]
Rheinheimera chironomi[3]
Rheinheimera soli[3]
Rhizobium etli[11]
Rhizobium leguminosarum bv. trifolii WSM1325, ref|ZP_02293701.1|[5]
Rhizobium leguminosarum bv. Viciae, gb|AAO21112.1|[5]
Rhizobium massiliae[3]
Rhizobium mesosinicum[11]
Rhizobium pisi[3]
Rhizobium radiobacter[2]
Rhodobacteraceae bacterium KLH11, gb|EEE38433.1|[5]
Rhodobacterales bacterium HTCC2654, ref|YP_002689546.1|[5]
Rhodococcus fascians[7]
Rhodopseudomonas palustris[5]
Rickettsia-like sp. [1]
Roseateles depolymerans[3]
Roseateles terrae[3]
Roseovarius nubinhibens ISM, ref|ZP_00958912.1|[5]
Roseovarius sp. TM1035, ref|ZP_01880909.1|[5]
Rothia amarae[3]
Ruminococcus bromii[3]
Salinivibrio costicola[3]
Salmonella enterica subsp. enterica serovar Dublin (ACH74415)[5]
Salmonella enterica subsp. enterica serovar Dublin (ACH74415)[5]
Salmonella enterica subsp. enterica serovar Heidelberg (ACF66546)[5]
Sediminibacillus halophilus[3]
Serratia liquefaciens [1]
Serratia marcescens [1]
Serratia marcescens[3]
Serratia marcescens, sp|Q684Q1.1|LUXS_SERMA[5]
Serratia marcescens, emb|CAJ86499.1|[5]
Serratia plymuthica [1]
Serratia proteamaculans [1]
Serratia sp. [1]
Serratia ureilytica[3]
Shewanella amazonensis SB2B, ref|YP_928287.1|[5]
Shewanella sp. [1]
Shigella flexneri[3]
Shigella sp. [1]
Shinella zoogloeoides[3]
Sinorhizobium medicae WSM419, ref|YP_001327237.1|[5]
Sphingobacterium daejeonense[3]
Sphingobium herbicidovorans[11]
Sphingomonas aromaticivorans[14]
Sphingomonas aurantiaca[12]
Sphingomonas dokdonensis[3]
Sphingomonas echinoides[3]
Sphingomonas echinoides[10]
Sphingomonas humi[3]
Sphingomonas koreensis[3]
Sphingomonas melonis[11]
Sphingomonas melonis[4]
Sphingomonas parapaucimobilis[10]
Sphingomonas paucimobilis [1]
Sphingomonas sp. M3C203B-B[12]
Sphingomonas sp. SKA58 (EAT09931)[5]
Sphingomonas sp. SKA58 (EAT09931)[5]
Sphingomonas subterranea[14]
Sphingomonas yabuuchiae[4]
Sphingomonas yanoikuyae[2]
Sphingomonas yanoikuyae[3]
Sphingopyxis panaciterrae[3]
Sphingosinicella sp.[3]
Sphingosinicella xenopeptidilytica[3]
Staphyloccus hominis [1]
Staphylococcus cohnii[3]
Staphylococcus capitis[3]
Staphylococcus epidermidis[11]
Staphylococcus epidermitis[6]
Staphylococcus hominis[3]
Staphylococcus lugdunensis[11]
Staphylococcus sp. [1]
Stenotrophomomonas sp. [1]
Stenotrophomonas maltophilia[7]
Stenotrophomonas maltophilia[2]
Stenotrophomonas maltophilia K279a, ref|YP_001972030.1|[5]
Stenotrophomonas maltophilia, gb|ABM53767.1|[5]
Stenotrophomonas pavanii[3]
Steroidobacter denitrificans[3]
Stigmatella aurantiaca DW4/3-1, ref|ZP_01462709.1|[5]
Streptococcus thermophilus[5]
Streptococcus thermophilus LMG 18311, ref|YP_138642.1|[5]
Streptomyces avermitilis MA-4680, ref|NP_824495.1|[5]
Streptomyces bottropensis[12]
Streptomyces cyaneus[14]
Streptomyces kathirae[14]
Streptomyces lincolnensis[14]
Streptomyces nodosus[14]
Streptomyces scabies[14]
Streptomyces sp. [1]
Streptomyces turgidiscabies[14]
Sulfitobacter sp. NAS-14.1, ref|ZP_00963622.1|[5]
Synechococcus sp. WH 5701 (EAQ76095)[5]
Synechococcus sp. WH 5701 (EAQ76095)[5]
Tatumella morbirosei[3]
Tepidimonas aquatic[3]
Thermomonas brevis[3]
Thermomonas koreensis[3]
Thiobacillus aquaesulis[3]
Thiobacter subterraneus[3]
Undibacterium sp.[3]
Variovorax boronicumulans[3]
Variovorax sp. [1]
Verrucomicrobiae bacterium DG1235, gb|EDY84015.1|[5]
Vibrio sp.[3]
Vibrio sp. [1]
Xanthomonas albilineans[11]
Xanthomonas axonopodis pv. citri str. 306, ref|NP_642203.1|[5]
Xanthomonas campestris [1]
Xanthomonas campestris pv. campestris str. B100, ref|YP_001903550.1|[5]
Xanthomonas oryzae [1]
Xanthomonas oryzae emb|CAA66459.1|[5]
Xanthomonas oryzae pv. oryzae KACC10331, ref|YP_201507.1|[5]
Xanthomonas sacchari[3]
Xanthomonas sp. [1]
Xanthomonas translucens[4]
Yersinia frederiksenii [1]
Yersinia sp. [1]
Zymomonas mobilis subsp. mobilis ZM4 (AAV89684)[5]
Zymomonas mobilis subsp. mobilis ZM4 (AAV89684)[5]

Reference Guide

| | |
|---|---|
| Reference 1 | Hurst, Christon J., et al. *Manual of environmental microbiology*. No. Ed. 3. ASM press, 2007 |
| Reference 2 | Hardoim, P. R., et al. (2012) PLoS ONE 7(2): e30438. |
| Reference 3 | Liu, Y., et al. (2013) Annals of Microbiology, 63(1), 71-79. |
| Reference 4 | Mano, H., et al. (2006) Microbes and Environment 21(2) 86-100 |
| Reference 5 | Sessitch, A. et al. (2012) MPMI 25(1) 28-36 |
| Reference 6 | Muhammad, N., et al. (2012) Endophytes E-COST FA1103 Working Group Meeting in Trento/S. Michele, Italy November 2012. (poster) |
| Reference 7 | Johnston-Monje D, Raizada MN (2011) PLoS ONE 6(6): e20396. |
| Reference 8 | Hurek, T., Reinhold-Hurek, B. (2003) J Biotechnol. 106(2-3): 169-78. |
| Reference 9 | Engelhard M., et al. (2000) Environ Microbiol. (2): 131-41. |

| Reference Guide | |
|---|---|
| Reference 10 | Okunishi, S., et al. (2005) Microbes and Environment 20(3) 168-177. |
| Reference 11 | Johnston-Monje, D., et al. (2013) BMC Plant Biology (submitted). |
| Reference 12 | Sessitch, A., et al. (2004) Canadian Journal of Microbiology 50: 4. p: 239. |
| Reference 13 | Sessitch, A., et al. IJSEM May 2005 vol. 55 no. 3 1187-1192 |
| Reference 14 | Sessitch, A., et al. (2002) FEMS Microbiology Ecology 39: 23-32 |
| Reference 15 | Minamisawa K., et al. (2004) Appl Environ Microbiol. 70(5): 3096-102.; Reference 7 |
| Reference 16 | Seghers, D. (2004) APPLIED AND ENVIRONMENTAL MICROBIOLOGY 1475-1482 |
| Reference 17 | Bulgari, D., et al. (2009) The Journal of Microbiology p. 393-401 |
| Reference 18 | Verstraete 2004 |
| Reference 19 | AMANN R., FUCHS B. M. (2008): Single-cell identification in microbial communities by improved fluorescence in situ hybridization techniques. Nature reviews microbiology 6: 339-348 |
| Reference 20 | Chelius M K, Triplett E W (2001) The diversity of archaea and bacteria in association with the roots of *Zea mays* L. Microbial Ecology 41: 252-263 |
| Reference 21 | Edwards U, Rogall T, Blocker H, Emde M, Bottger E C (1989) Isolation and direct complete nucleotide determination of entire genes - Characterisation of a gene coding for 16S-ribosomal RNA. Nucleic Acids Research 17: 7843-7853. |
| Reference 22 | Prischl, M., Hackl, E., Pastar, M., Pfeiffer, S. and Sessitsch A. (2012) Genetically modified Bt maize lines containing cry3Bb1, cry1A105 or cry1Ab2 do not affect the structure and functioning of root-associated endophyte communities. Appl Soil Ecol 54, 39-48. |
| Reference 23 | NAVEED, M., MITTER B., YOUSAF S., PASTAR M., AFZAL M., SESSITSCH A. 2014. The endophyte *Enterobacter* sp. FD17: a maize enhancer selected based on rigorous testing of plant beneficial traits and colonization characteristics. *Biology and Fertility of Soils* 50: 249-262. |
| Reference 24 | Madi, L. and Henis, Y. (1989) Aggregation in *Azospirillum brasilense* Cd: conditions and factors involved in cell-to-cell adhesion. *Plant Soil* 115, 89-98. |
| Reference 25 | Rashid, M. H. and Kornberg, A. (2000) Inorganic polyphosphate is needed for swimming, swarming, and twitching motilities of *Pseudomonas aeruginosa. Proc Natl Acad Sci USA* 97, 4885-1890. |
| Reference 26 | Djordjevic, D., Wiedmann, M. and McLandsborough, L. A. (2002) Microtiter plate assay for assessment of *Listeria monocytogenes* biofilm formation. Appl Environ Microbiol 68, 2950-2958. |
| Reference 27 | Medina, P. and Baresi, L. (2007) Rapid identification of gelatin and casein hydrolysis using TCA. *J Microbiol Methods* 69, 391-393. |
| Reference 28 | Sarwar, M., M. Arshad, D. A. Martens and W. T. Jr. Frankenberger. 1992. Tryptophane-dependendent biosynthesis of auxin in soil. *Plant Soil*, 147: 207-215. |
| Reference 29 | Feller et al., In: Meier U. (ed.) (2001): Growth stages of mono- and dicotyledonous plants. Federal Biological Research Center for Agriculture and Forestry, 2nd edition |
| Reference 30 | Mehta, S. and Nautiyal, C. S. (2001) An efficient method for screening phosphate solubilization bacteria. *Curr Microbiol* 43, 57-58. |
| Reference 31 | Rosado, A. S., De Azevedo, F. S., da Croz. D. W., Van Elas, J. D. and Seldin, L. (1998) Phenotypic and genetic diversity of *Paenibacillus azatofeixans* strains isolated from the rhizophere soil of different grasses. *J Appl Microbiol* 84, 216-226. |
| Reference 32 | Schwyn, B. and Neilands, J. B. (1987) Universal chemical assay for the detection and determination of siderophores. *Anal Biochem* 160, 47-56. |
| Reference 33 | Weaver, P. K., Wall, J. D. and Gest H. (1975) Characterization of *Rhodopseudomonas capsulata. Arch Microbiol* 105, 207-216. |
| Reference 34 | Cappuccino, J. G. and Sherman, N. (1992) Biochemical activities of microorganisms. In *Microbiology, A Laboratory Manual*. The Benjamin/Cummings Publishing Co. California, USA. |
| Reference 35 | Liu, M. Gonzalez, J. E., Willis, L. B.,. and Walker, G. C. (1998) A Novel Screening Method for Isolating Exopolysaccharide deficient Mutants. *Appl Environ Microbiol* 64, 4600-4602. |
| Reference 36 | Spiekermann, P., Rehm, B. H. A., Kalscheuer, R., Baumeister, D. and Steinbuchel, A. (1999) A sensitive, viable-colony staining method using Nile red for direct screening of bacteria that accumulate polyhydroxyalkanoic acids and other storage compounds. *Arch Microbiol* 171, 73-80. |
| Reference 37 | Cha, C., Gao, P., Chen, Y. C., Shaw, P. D. and Farrand, S. K. (1998). Production of acyl-homoserine lactone quorum-sensing signals by gram-negative plant associated bacteria. *Mol Plant-Microbe Interact* 11, 1119-1129 |
| Reference 38 | Männistö, M. K. and Häggblom, M. M. (2006) Characterization of psychrotolerant heterotrophic bacteria from Finnish Lapland. *Syst Appl Microbiol* 29, 229-243. |
| Reference 39 | Teather, R. M. and Wood, P. J. (1982) Use of congo red-polysacharide interactions in enumeration and characterization of cellulolytic bacteria in the bovine rumen. *Appl Environ Microbiol* 43, 777-780. |
| Reference 40 | Chernin, L. S., Winson, M. K., Thompson, J. M., Haran, S., Bycroft, B. W., Chet, I., Williams, P. and Stewart, G. S. A. B. (1998) Chitinolytic activity in *Chromobacterium violaceum*: Substrate analysis and regulation by quorum sensing. *J Bacterial* 180, 4435-4441. |
| Reference 41 | Mateos, P. F., Jimenez-Zurdo, J. I., Chen, J., Squartini, A. S., Haack, S. K., Martinez-Molina, E., Hubbell, D. H. and Dazzo, F. B. (1992) Cell-associated pectinolytic and cellulolytic enzymes in *Rhizobium leguminosarum* biovar *trifolii*. *Appl Environ Microbiol* 58, 1816-1822. |
| Reference 42 | Abarenkov, K., R. Henrik Nilsson, K.-H. Larsson, I. J. Alexander, U. Eberhardt, S. Erland, K. Høiland, R. Kjøller, E. Larsson, T. Pennanen, R. Sen, A. F. S. Taylor, L. Tedersoo, B. M. Ursing, T. Vrålstad, K. Liimatainen, U. Peintner, and U. Kõljalg. 2010. The UNITE database for molecular identification of fungi - recent updates and future perspectives. New Phytologist 186: 281-285. |

| Reference Guide | |
|---|---|
| Reference 43 | Dunn, R. R., N. Fierer, J. B. Henley, J. W. Leff, and H. L. Menninger. 2013. Home life: factors structuring the bacterial diversity found within and between homes. PLoS One 8: e64133. |
| Reference 44 | Edgar, R. C. 2013. UPARSE: highly accurate OTU sequences from microbial amplicon reads. Nature methods 10: 996-8. |
| Reference 45 | Fierer, N., J. W. Leff, B. J. Adams, U. N. Nielsen, S. T. Bates, C. L. Lauber, S. Owens, J. a. Gilbert, D. H. Wall, and J. G. Caporaso. 2012. Cross-biome metagenomic analyses of soil microbial communities and their functional attributes. Proceedings of the National Academy of Sciences |
| Reference 46 | Lundberg, D. S., S. Yourstone, P. Mieczkowski, C. D. Jones, and J. L. Dangl. 2013. Practical innovations for high-throughput amplicon sequencing. Nature methods 10: 999-1002. |
| Reference 47 | McDonald, D., M. N. Price, J. Goodrich, E. P. Nawrocki, T. Z. DeSantis, A. Probst, G. L. Andersen, R. Knight, and P. Hugenholtz. 2012. An improved Greengenes taxonomy with explicit ranks for ecological and evolutionary analyses of bacteria and archaea. The ISME journal 6: 610-8. |
| Reference 48 | McGuire, K. L., S. G. Payne, M. I. Palmer, C. M. Gillikin, D. Keefe, S. J. Kim, S. M. Gedallovich, J. Discenza, R. Rangamannar, J. a Koshner, A. L. Massmann, G. Orazi, A. Essene, J. W. Leff, and N. Fierer. 2013. Digging the New York City Skyline: soil fungal communities in green roofs and city parks. PloS one 8: e58020. |
| Reference 49 | Wang, Q., G. M. Garrity, J. M. Tiedje, and J. R. Cole. 2007. Naive Bayesian classifier for rapid assignment of rRNA sequences into the new bacterial taxonomy. Applied and environmental microbiology 73: 5261-7. |
| Reference 50 | Edgar, R. C. 2010. Search and clustering orders of magnitude faster than BLAST. Bioinformatics 26: 2460-2461. |
| Reference 51 | Lundberg, D. S., S. L. Lebeis, S. H. Paredes, S. Yourstone, J. Gehring, S. Malfatti, J. Tremblay, A. Engelbrektson, V. Kunin, T. G. del Rio, R. C. Edgar, T. Eickhorst, R. E. Ley, P. Hugenholtz, S. G. Tringe, and J. L. Dangl. 2012. Defining the core *Arabidopsis thaliana* root microbiome. Nature 488: 86-90. |
| Reference 52 | R Core Team. 2013. R: A Language and Environment for Statistical Computing. R Foundation for Statistical Computing, Vienna, Austria. |
| Reference 53 | Massol-Deya A. A., Odelson D. A., Hickey R. F., Tiedje J. M. 1995. In: Molecular Microbial Ecology Manual. p289-296. Ed.: Akkermans A. D. L., Van Elsas J. D., De Bruijn F. J. Springer Netherlands. |

TABLE 3

GENBANK ACCESSION NOS OF ADDITIONAL BACTERIAL ENDOPHYTES

AF226166
AF226167
AF226168
AF226169
AF226170
AF226171
AF226172
AF226173
AF226174
AF226175
AF226176
AF226177
AF226178
AF226179
AF226180
AF226181
AF226182
AF226183
AF226184
AF226185
AF226186
AF226187
AF226188
AF226189
AF226190
AF226191
AF226192
AF226193
AF226194
AF226195
AF226196
AF226197
AF226198
AF226199
AF226200
AF226201

TABLE 3-continued

GENBANK ACCESSION NOS OF ADDITIONAL BACTERIAL ENDOPHYTES

AF226202
AF226203
AF226204
AF226205
AF226206
AF226207
AF226208
AF226209
AF226210
AF226211
AF226212
AF226213
AF226214
AF226215
AF226216
AF226217
AF226218
AF226219
AF226220
AF226221
AF226222
AF226223
AF226224
AF226225
AF226226
AF226227
AF226228
AF226229
AF226230
AF226231
AF226232
AF226233
AF226234
AF226235
AF226236
AF226237

TABLE 3-continued

GENBANK ACCESSION NOS OF ADDITIONAL BACTERIAL ENDOPHYTES

| |
|---|
| AF226238 |
| AF226239 |
| AF226240 |
| AF226241 |
| AF226242 |
| AF226243 |
| AF226244 |
| AF226245 |
| AF226246 |
| AF226247 |
| AF226248 |
| AF226249 |
| AF226250 |
| AF226251 |
| AF226252 |
| AF226253 |
| AF226254 |
| AF226255 |
| AF226256 |
| AF226257 |
| AF226258 |
| AF226259 |
| AF226260 |
| AF226261 |
| AF226262 |
| AF226263 |
| AF226264 |
| AF226265 |
| AF226266 |
| AF226267 |
| AF226268 |
| AF226269 |
| AF226270 |
| AF226271 |
| AF226272 |

TABLE 4

FUNGAL GENERA

*Allodus, Allomyces, Allosoma, Aloysiella, Alphitomyces, Alternaria, Alveolaria, Alysisporium, Amallospora, Amanita, Amanitella, Amanitopsis, Amastigis, Amastigosporium, Amaurascus, Amazonia, Amblyosporiopsis, Amblyosporium, Ameghiniella, Ameris, Amerodothis, Amerosporiella, Amerosporis, Amerosporium, Anierostege, Amoebochytrium, Amorphomyces, Amphichaeta, Amphichaete, Amphichaetella, Amphiciliella, Amphicytostroma, Amphididymella, Amphiernia, Amphinectria, Amphischizonia, Amphisphaeria, Amphorula, Ampullaria, Amylirosa, Amylis, Anaphysmene, Anaptychia, Anapyrenium, Anariste, Anatexis,* Ancylistaceae, *Ancylistes, Andreaea, Andreaeana, Anellaria, Anema, Angatia, Angelinia, Angiopoma, Angiopomopsis, Anhellia, Anisochora, Anisogramma, Anisomjces, Anisomyxa, Anisostomula, Anixia, Anixiopsis, Annularia, Anomomyces, Anomorpha, Anomothallus, Antenella, Antenellina, Antennulariella, Anthina, Anthomyces, Anthomyces, Anthomycetella, Anthostoma, Anthostomaria, Anthostomella, Anthostomellina, Anthracoderma, Anthracoidea, Anthracophyllum, Anthracothecium, Anthurus, Antromyces, Antromycopsis, Anzia, Aorate, Aphanascus, Aphanomyces, Aphanomycopsis, Aphanopeltis, Aphanostigme, Aphysa, Apiocarpella, Apiocrea, Apiognomonia, Apioporthe, Apioporthella, Apiorhynchostoma, Apiosphaeria, Apiospora, Apiosporella, Apiosporina, Apiosporina, Apiosporium, Apiosporopsis, Apiotrabutia, Apiotypa, Aplacodina, Aplanes, Aplopsora, Apocytospora, Apodachlya, Apodya, Aponectria, Aporhytisma, Aporophallus, Aposphaeria, Aposphaeriella, Aposphaeriopsis, Aposporella, Apostemidium, Appendicularia, Apyrenium, Arachniopsis, Arachniotus, Arachnium, Arachnomyces, Arachnopeziza, Araeospora, Araneomyces, Arcangelia, Arcangeliella, Arctomia, Arenaea, Areolaria, Argomycetella, Argopsis, Argynna, Armatella, Armillaria, Arnaudiella, Arrhenia, Arrhytidia, Arthonia, Arthoniactis, Arthoniae, Arthoniopsis, Arthotheliopsis, Arthothelium, Arthrinium, Arthrobotryella, Arthrobotrys, Arthrobotryum, Artlirobotryum, Arthropyrenia, Arthropyreniella, Arthrorhynchus, Arthrosporium, Articularia, Articulariella, Articulis, Asbolisia, Aschersonia, Aschersoniopsis,* Ascobolaceae, *Ascobolae, Ascobolus, Ascocalathium, Ascochyta, Ascochytella, Ascochytopsis, Ascochytula, Ascochytulina, Ascocorticium, Ascodesmis, Ascoidea,* Ascoideaceae, *Ascomycetella,* Ascomycetes, *Ascophanae, Ascophanus, Ascopolyporus, Ascosorus, Ascospora, Ascostratum, Ascotricha, Aseroe, Ashbia, Aspergillae, Aspergillopsis, Aspergillus, Aspergillus, Asperisporium, Aspidopyrenis, Aspidopyrenium, Aspidothea, Aspidothelium, Asporomyces, Asterella, Asteridiella, Asteridiellina, Asteridium, Asterina,* Asterineae, *Asterinella, Asteristium, Asterocalyx, Asteroconium, Asterodon, Asterodothis. Asterolibertia, Asteroma, Asteromassaria, Asteromella, Asteromidium, Asteromyxa, Asteronaevia, Asteronia, Asteropeltis, Asterophlyctis, Asterophora, Asteroporum, Asteropsis, Asterosporium, Asterostomella, Asterostomula, Asterostroma, Asterostromella, Asterothyrium, Asterothyrium, Astraeus, Astrocystis, Astrodochium, Astrosphaeriella, Astrotheliae, Astrothelium, Atichia, Atopospora, Atractiella, Atractilina, Atractina, Atractium, Atrichophytum, Auerswaldia, Auerswaldiella, Auerswaldiopsis, Aulacostroma, Aulaxina, Aulographella, Aulographis, Aulographum, Aureobasidium, Aureobasis, Auricularia,* Auriculariaceae, *Auriculariclla, Autoecomyces, Avettaea, Bacidia, Bactrexcipula, Bactridiopsis, Bactridium, Bactrosphaeria, Bactrospora, Baculospora, Baeodromus, Baeomyces, Baeumleria, Baggea, Bagnisiella, Bagnisiopsis, Bakeromyces, Bakerophoma, Balansia, Balansiella, Balansina, Balansiopsis, Balladyna, Balladynella, Balladynopsis, Balsamia, Balzania, Barclayella, Bargellinia, Barlaea, Barlaeina, Barssia, Bartalinia, Barya, Basiascella, Basiascum, Basidiella, Basidiobolus, Basdiobotrys,* Basidiomycetes, *Basidiophora, Basilocula., Basisporium, Battarina, Battarrea, Battarreopsis, Baunianniella, Baumiella, Beauveria, Beccariella, Beelia, Belonia, Belonidium, Beloniella. Belonioscypha, Belonioscyphella, Belonium, Bclonopeziza, Belonopsis, Belospora, Beltrania, Benguetia, Beniowskia, Berkelella, Berlesiella, Bertia, Bertiella, Bertiella, Biatora, Biatorella, Biatorellina, Biatorina, Bifusella, Bionectria, Bioporthe, Bioscypha, Biotyle, Bispora, Bisporella, Bivonella, Bizzozeria, Bizzozeriella, Blakeslea, Blasdalea, Blastenia, Blastocladia,* Blastocladiaceae, *Blastodendrum, Blastoderma, Blastodesmia, Blastomyces, Blastomycoides, Blastospora, Blastotrichum, Blennoria, Blennoriopsis, Blepharospora, Blodgettia, Bloxamia, Blumenavia, Blytridium, Bodinia, Boerlagella, Bolacotricha, Bolbitius, Boletinus, Boletogaster, Boletopsis, Boletus, Bolinia, Bolosphaera, Bombardia, Bombardiastrum, Bombardiella, Bombyliospora, Bommerella, Bonanseia, Bonia, Bonordeniella,*

TABLE 4-continued

FUNGAL GENERA

*Bonplandiella, Borenquenia, Bostrichonema, Bothrodiscus, Botrydiplis, Botryella, Botryochora, Botryoconis, Botryogene, Botryophoma, Botryorhiza, Botryosphaeria, Botryosphaerostroma, Botryosporium, Botryostroma, Botryotrichum, Botrysphaeris, Botrytidae, Botrytis, Bottaria, Boudiera, Boudierella, Bourdotia, Bovilla, Bovista, Bovistella, Bovistoides, Boydia, Brachyascus, Brachysporium, Brefeldiella, Bremia, Bremiella, Brencklea, Brenesiella, Bresadolella, Bresadolia, Bresadolina, Brevilegnia, Briardia, Briarea, Brigantiella, Briosia, Broomeia, Broomella, Brunchorstia, Bryophagus, Bryopogon, Bubakia, Buellia, Bulbothamnidium, Bulgaria,* Bulgariaceae, *Bulgariastrum, Bulgariella, Bulgariopsis, Bullaria, Bullera, Bulliardella, Burkardia, Burrillia, Butleria, Byssocallis, Byssochlamys, Byssocystis, Byssogene, Byssolecania, Byssoloma, Byssolomae, Byssolophis, Byssonectria, Byssotheciella, Cacosphaeria, Cadophora, Caenomyces, Caenothyrium, Caeoma, Calathiscus, Calcarisporium, Caldariomyces, Caldesia, Caldesiella, Calenia, Caleniae,* Caliciaceae, *Caliciopsis, Calicium, Calidion, Calliospora, Calloria, Calloriella, Calloriopsis, Calocera, Calocladia, Caloderma, Calogloeum, CaloIepis, Calonectria, Calopactis, Calopeltis, Calopeziza, Calopeziza, Caloplaca, Calosphaeria, Calospora, Calosporella, Calostilbe, Calostilbella, Calostoma, Calothyriella, Calothyriolum, Calothyriopeltis, Calothyriopsis, Calothyris, Calothyriuni, Calotrichopsis, Calvatia, Calycella, Calycellina, Calycidium, Calyculosphaeria, Calyptospora, Calyptra, Calyptralegnia,* Calyptronectri?., *Camarographium, Camarops, Camarosporellum, Camarosporium, Camarosporulum, Camarotella, Camillea, Cainpanella, Campbellia, Campoa, Campsotrichum, Camptomeris, Camptomyces, Camptosphaeria, Camptoum, Campylothelium, Candelaria, Candelariella, Candelospora, Candida, Cantharellus, Cantharomyces, Cantharosphaeria, Capillaria, Capnites, Capnodaria,* Capnodiaceae, *Capnodiastrum, Capnodiella, Capnodina, Capnodinula, Capnodiopsis, Capnodium, Capnophaeum, Capnostysanus, Capronia, Carestiella, Carlia, Carlosia, Carothecis, Carpenteles, Caryospora, Casaresia, Castagnella, Castoreum, Catabotrys, Catacauma, Catacaumella, Catastoma, Catathelasma, Catenaria, Catenularia, Catharinia, Catilla, Catillaria, Catinaria, Catinella, Catinula, Catocarpus, Caudella, Caudospora, Caudosporella, Cauloglossum Causalis, Celidium, Celtidea, Cenangella, Cenangina, Cenangiopsis, Ctfnangium, Cenococcum, Cephaliophora, Cephalodochium, Cephalomyces, Cephalosporiae, Cephalosporium, Cephalotelium, Cephalotheca, Cephalothecium, Cephalotrichum, Ccracea, Ceraeomyces, Cerastomis, Ceratocarpia, Ceratochaete, Ceratochaetopsis, Ceratocladium, Ceratomyces,* Ceratomycetaceae, *Ceratophoma, Ceratophorum, Ceratoporthe, Ceratopycnidium, Ceratopycnis, Ceratopycnium, Ceratosperma, Ceratosphaeria, Ceratosporella, Ceratosporium, Ceratostoma, Ceratostomella, Cercidospora, Cercoseptoria, Cercosphaerella, Cercospora, Cercosporella, Cercosporidium, Cercosporina, Cercosporiopsis, Cerebella, Cerillum, Ceriomyces, Cerion, Ceriophora, Ceriospora, Ceriosporella, Cerocorticium, Cerotelium, Cesatiella, Cetraria, Ceuthocarpum, Ceuthodiplospora, Ceuthosira, Ceuthospora, Ceuthosporella, Chaconia, Chaenoderma, Chaenotheca, Chaetalysis, Chaetasbolisia, Chaetaspis, Chaetasterina, Chaetobasidiella, Chaetobasis, Chaetobotrys, Chaetoccratostoma, Chaetoceris, Chaetocladiae, Chaetocladium, Chaetoconidium, Chaetoconis, Chaetocrea, Chaetocytostroma, Chaetodiplis, Chaetodiplodia, Chaetodiplodina, Chaetodiscula, Chaetolentomita, Chaetomastia, Chaetomella, Chaetomeris, Chaetomidium, - Chaetomium, Chaetomyces, Chaetopcltiopsis, Chaetopeltis, Chaetopeltopsis, Chaetophiophoma, Chaetophoma, Chaetophomella, Chaetoplaca, Chaetoplea, Chaetopsis, Chaetopyrena, Chaetopyrenis, Chaetosclerophonia, Chaetoscypha, Chaetosira, Chaetospermum, Chaetosphaeria, Chaetosphaeronema, Chaetosphaeropsis, Chaetosticta, Chaetostigme, Chaetostigmella, Chaetostroma, Chaetostroma, Chaetostromella, Chaetostylum, Chaetotheca, Chaetothyrina, Chaetothyriolum, Chaetothyriopsis, Chaetothyrium, Chaetotrichum, Chaetozythia, Chaetyllis, Chalara, Chalaropsis, Chalcosphaeria, Chamonixia, Chantransiopsis, Charcotia, Charonectria, Charrinia, Cheilaria, Cheilymenia, Chelisporium, Chevaliera, Chevalieropsis, Chiajea, Chiastospora, Chiloella, Chilomyces, Chilonectria, Chiodectae, Chiodectum, Chiroconium, Chiromycella, Chiromyces, Chiropodium, Chitonia, Chitoniella, Chitonomyces, Chitonospora, Chlamydaleurosporia, Chlamydomucor, Chlamydomyces, Chlamydopus, Chlamydosporium, Chloridium, Chlorocaulum, Chlorodothis, Chloropeltis, Chlorophyllum, Chlorospleniella, Chlorosplenium, Chlorospora, Chnoopsora, Choanophora, Choanophorae, Choeromyces, Chondrogaster, Chondropodiella, Chondropodium, Choriactis, Chorostate, Chorostella, Chroinocrea, Chromocreopsis, Chromocytospora, Chromosporium, Chromotorula, Chrysella, Chrysocelis, Chrysocyclus, Chrysomyces, Chrysomyxa, Chrysopsora, Chrysothrix,* Chrysotrichaceae, Chytridiaceae, Chytridiae, Chytridiales, *Chytridium, Ciboria,* CicadomyceSi *Cicinnobella, Cicinnobolus, Cidaris, Ciferria, Ciliaria, Ciliciocarpus, Ciliciopodium, Ciliciopus, Ciliella, Ciliochora, Ciliofusa, Ciiiofusarium, Ciliomyces, Ciliophora, Ciliospora, Ciliosporella. Cintractia, Cionothrix, Circinastruni, Circinella, Circinotrichum, Cirromyces, Cirsosia, Cirsosiella, Citromyccs, Cladobotryum, Cladochaete,* Cladochytriae, *Cladochytrium, Cladoderris, Cladographium, Cladonia,* Cladoniaceae, *Cladorhinum, Cladosphaeria, Cladosporium, Cladosterignia, Cladotrichum, Clarkeinda, Clasterosporium, Clathrella, Clathridium, Clathrococcum, Clathrogaster, Clathroporina, Clathrospora, Clathrotrichum, Clathrus, Claudopus, Claussenomyces, Claustula, Clavaria,* Clavariaceae, *Clavariopsis, Clavariopsis, Claviceps, Clavogaster, Clavularia, Clavulinopsis, Cleistophoma, Cleistosoma, Cleistosphaera, Cleistotheca, Cleistothecopsis, Clematomyces, Cleptomyces, Clidiomyces, Cliniconidium, Clinterium, Clintoniella, Cliostomum, Clistophoma, Clistosoma, Clistosphaera, Clistotheca, Clistothecopsis, Clithris, Clitocybe, Clitopilus, Clonostachyopsis, Clonostachys, Closteraleurosporia, Closterosporia, Clypeochorella, Clypeodiplodina, Clypeolella, Clypeolina, Clypeolina,* riypeolopsis, *Clypeolum, Clypeoporthc, Clypeoporthella, Clypeopycnis, Clypcoseptoria, Clypeosphaeria, Clypeostignia, Clypeostroma, Clypeothecium, Clypeotrabutia, Coccidiascus, Coccidiodes, Coccidomyces, Coccidophthora, Cocciscia, Coccobotrys, Coccocarpia, Coccochora, Coccochorella, Coccodiella, Coccodinium, Coccodiscus, Coccodothella, Coccodothis, Coccoidea, Coccoidella, Coccomycella, Coccomyces, Coccomycetella, Cocconia, Cocconiopsis, Coccopeziza, Coccophacidium, Coccospora, Coccosporella, Coccosporium, Coccostroma, Coccostromopsis, Coccotrema, Coelographium, Coelomyces, Coelomycidium, Coelosphaeria, Coemansia, Coemansiella, Coenogonium, Coleodictyospora, Coleodictys, Coleonaema, Coleophoma, Coleopuccinia, Coleosporium, Coleroa, Collacystis, Collema,* Collemaceae, *Collemis, CoUemodes, Collemopsidium, Colletomanginia, Colletotrichella, Colletotrichopsis, Colletotrichum Collodochium, Collonaema, Collonaemella, Collybia, Collyria, Colpoma, Coipomella, Columnophora,*

TABLE 4-continued

FUNGAL GENERA

*Columnothyrium, Colus, Combea, Comesia, Comoclathris, Complectoria, Compsomyces, Confervales, Conida, Conidiascus, Conidiobolus, Cordelia, Coniocarpum, Coniochaeta, Coniocybe, Coniodictyum, Coniophora, Coniophorella, Conioscypha, Coniosporium, Coniothecium, Coniothyrella, Coniothjriella, Coniothyrina, Coniothyrimila, Coniothyriopsis, Coniothyriopsis, Coniothyris, Coniothyrium, Conoplea, Conostroma, Conotheciella, Conotrema, Constantinella, Cookeina, Cookella, Copelandia, Copranophilus, Coprinopsis, Coprinus, Coprolepa, Cora, Corallodendrum, Corallomyces, Coraliomycetella, Cordana, Cordelia, Cordierites, Corditubera, Cordyceps, Corella, Coremiella, Coremium, Coreomyces, Corethromyces, Corethropsis, Cornicularia, Corniculariella, Cornucopiella, Cornuella, Cornularia, Corollium, Corollospora, Coronella, Coronophora, Coronophorella, Coronotelium, Corticium, Cortinarius, Corymbomyces, Coryne, Corynelia,* Coryneliaceae, *Coryneliella, Corynespora, Corynetes, Coryneum, Coscinaria, Coscinopeltis, Cosmariospora, Coutinia, Couturea, Crandallia, Craterellus, Craterocolla, Creomelanops, Creonectria, Creosphaeria, Creothyrium, Crepidotus, Criella, Crinula, Crinula, Criserosphaeria, Cristulariella, Crocicreas, Crocynia, Cronartium, Crossopsora, Crotone, Crotonocarpia, Crucibulum, Crumenula, Cryphonectria, Cryptascus, Cryptica, Cryptobasidium, Cryptoceuthospora, Cryptocline, Cryptococcus, Cryptocoryneum, Cryptoderis, Cryptodiaporthe, Cryptodidymosphaeria, Cryptodiscus, Cryptoleptosphaeria, Cryptomela, Cryptomycella, Cryptomyces, Cryptomycina, Cryptonectriopsis, Cryptopeltis, Cryptopeltosphaeria, Cryptopezia, Cryptophaella, Cryptophallus, Cryptoporus, Cryptopus, Cryptorhynchella, Cryptorhynchella, Cryptosphaerella, Cryptosphaeria, Cryptosphaerina, Cryptospora, Cryptosporella, Cryptosporina, Cryptosporiopsis, Cryptosporium, Cryptostictella, Cryptostictis, Cryptothecium, Cryptothele, Cryptothelium, Cryptovalsa, Ctenoderma, Ctenomyces, Cubonia, Cucurbidotliis, Cucurbitaria, Cucurbitariella, Cudonia, Cudoniella, Cutininghaniella, Cunninghamia, Curreya, Curreyella, Cuticularia, Cutomyces, Cyanobaeis, Cyanocephalum, Cyanochyta, Cyanoderma, Cyanophomella, Cyanospora, Cyathicula, Cyathus, Cycloconium, Cycloderma, Cyclodomus, Cyclodothis, Cyclographa, Cyclomyces, Cycloschizella, Cycloschizum, Cyclostoniella, Cyclotheca, Cyclothyrium, Cylindrina, Cylindrium, Cylindrocarpum, Cylindrocephalum, Cylindrocladium, Cylindrocolla, Cylindrodendrum, Cylindrophora, Cylindrosporelia, Cylindrosporium, Cylindrothyrium, Cylindrotrichum, Cylomyces, Cyniatella, Cyphelium, Cyphella, Cyphellomyces, Cyphellopycnis, Cyphina, Cyphospilea, Cystingophora, Cystodendrum, Cystolobis, Cystomyces, Cystophora, Cystopsora, Cystopus, Cystospora, Cystotelium, Cystotheca, Cystothyrium, Cystotricha, Cytidia, Cytodiplospora, Cytogloeum, Cytonaema, Cytophoma, Cytoplacosphaeria, Cytoplea, Cytosphaera, Cytospora, Cytosporella, Cytosporina, Cytosporium, Cytostaganis, Cytostaganospora, Cytotriplospora, Cyttaria,* Cyttariaceae, *Dacrymycella, Dacryobolus, Dacryodochium, Dacryomitra, Dacryomyces,* Dacryomycetaceae, *Dacryopsella, Dacryopsis, Dactylaria, Dactylella, Dactylina, Dactylium, Dactylomyces, Dactylosporium,* Daedalea, *Daldinia, Daleomyces, Dangeardia, Dangeardiella, Darbishirella, Darluca, Darlucis, Darwiniella, Dasybolus, Dasypezis, Dasyphthora, Dasypyrena, Dasyscypha, Dasyscyphae, Dasyscyphella, Dasysphaeria, Dasyspora, Dasysticta, Dasystictella, Davincia, Davinciella, Davisiella, Dearnessia, Debaryella, Debaryoniyces, Deconica, Delacourea, Delastria, Delastriopsis, Delitschia, Delitschiella, Delortia, Delphinella, Delpinoella, Delpontia,* Dematiaceae, *- Dematium, Dendrocladium, Dendrocyphella, Dendrodochium, Dendrodomus, Dendroecia, Dendrogaster, Dendrographa, Dendrographium, Dendrophoma, Dendrosphaera, Dendrostilbella, Dendrothele, Dendryphiella, Dendryphium, Dermatea,* Dermateaceae, *Dermatella, Dermatina, Dermatiscum, Dermatocarpae, Dermatocarpum, Dermatodothis, Dermophyta, Desmazierella, Desmella, Desmidiospora, Desmopatella, Desmotascus, Detonia,* Deuteromycetes, *Dexteria, Diabole, Diachora, Diachorella, Dialhypocrea, Dialonectria, Diaphanium, Diaporthe, Diaporthella, Diaporthopsis, Diarthonis, Diathryptum, Diatractium, Diatrype, Diatrypella,* : *Dibaeis, Dibelonis, Diblastospermella, Diblepharis. Dicaeoma, Dicarpella, Dichaena, Dichaenopsis, Dichaetis, Dichirinia, Dichlaena, Dichlamys, Dichomera, Dichomyces, Dichoporis, Dichosporium, Dichostereum, Dichothrix, Dichotomella, Dichotonium, Dicoccum, Dicollema, Dicranidium, Dicranophora, Dictyobole, Dictyocephalus, Dictyochaeta, Dictyochora, Dictyochorella, Dictyodothis, Dictyographa, Dictyolus, DictyomoUis, Dictyonella, Dictyonema, Dictyonia,* Dictyopeltineae, *Dictyopeltis, Dictyophora, Dictyorinis, Dictyosporium, Dictyothyriella, Dictyothyrina, Dictyothyrium, Dictyuchus, Dicyma, Didothis, Didymaria, Didymariopsis, Didymascella, Didymascella, Didymascina, Didymascus, Didymella, Didymellina, Didymellopsis, Didymobotryopsis, Didymobotrys, Didymobotryum,* Didymochaete, *Didymochlamys, Didymochora, Didymocladium, Didymocoryne, Didymopsamma, Didymopsis, Didymopsora, Didymosphaeria, Didymosporiella, Didymosporina, Didymosporis, Didymosporium, Didymostilbe, Didymothozetia, Didymotricha, Didymotrichum, Diedickea, Diedickella, Dielsiella, Dietelia, Digraphis, Dilophia, Dilophospora, Dimargaris, Dimeriella, Dimeriellopsis, Dimerina, Dimerinopsis, Dimeriopsis, Dimerisma, Dimerium, Dimeromyces, Dimerosporiella, Dimerosporina, Dimerosporiopsis, Dimerosporium, Dimorphomyces, Dinemasporiella, Dinemasporiopsis, Dinemasporis, Dinemasporium, oecomyces, oranotropis, orchidium, phaeis, phaeostica, phanis, phanosticta, phloeis, plocarpa, plocarpum, ploceras, plochora, plochorella, plocladium, plococcium, plocryptis, plocystis, plodascus, ploderma, plodia, plodiella, plodina, plodinis, plodiopsis, plodothiorella, plogramma, ploidium, plomyces, plonaevia, ploospora, plopeltis, plopeltis, plopeltopsis, plophlyctis, plophysa, ploplacis, ploplacosphaeria, ploplenodomopsis, ploplenodomus, plorhinotrichum, ploschistes, plosclerophoma, plosphaerella, plosporis, plosporium, plostephanus, plotheca, plotomma, plozythia, plozythiella, porina, pyrenis, rina, rinae, rinaria, rinastrum, saeta, scella,* scellaceae, *scellae, scina, sciseda, scocera, scochora, scocolla, scocyphella, scodiaporthe, scodothis, scofusarium, scogloeum, scomycella, scomycopsella, scomycopsis, scosia, scosiella, scosphaerina, scosporella, scosporiella, scosporiopsis, scosporium, scostroma, scostromella, scotheciella, scothecium, Discozythia, Discula, Disculina, Disperma, Dispira, Dissophora, Distichomyces, Dithelopsis, Dithozetia, Ditiola, Ditopella, Ditremis, Ditylis, Doassansia, Doassansiopsis, Doratomyces, Dothichiza, Dothichloe, Dothiclypeolum, Dothidasteris, Dothidasteroma, Dothidasteromella, Dothidea,* Dothideaceae, *Dothideae,* Dothideales, *Dothidella, Dothideodiplodia, Dothideopsella, Dothideovalsa, Dothidina, Dothidotthia, Dothiopsis, Dothiora, Dothiorae, Dothiorellina, Dothiorina, Dothisphaeropsis, Dothithyriella, Dothophaeis, Drepanoconis, Drepanopeziza, Drepanospora, Dubiomyces, Ductifera,*

TABLE 4-continued

FUNGAL GENERA

*Dufourea, Duplicaria, Duportella, Durandia, Durandiomyces, Durella, Dussiella, Dyslachnum, Dyslecanis, Dysrhynchis, Dysticta, Dystictina, Earlea, Ecchyna, Eccilia, Echidnodella, Echidnodes, Echinobotryum, Echinodontium, Echinodothis, Echinophallus, Echinothecium, Echusias, Ectinomyces, Ectosphaeria, Ectosticta, Ectostroma, Ectotrichophytum, Ectrogella, Eichleriella, Eidamella, Elachopeltis, Elaeodema, Elaphomyces,* Elaphomycetaceae, *Elasmomyces, Elateromyces, Eleutheris, Eleutheromycella, Eleutheromyces, Eleutherosphaera, Ellisiella, Ellisiodothis, Elmeria, Elmerina, Elmerococcum, Elsinoae, Elsinoe, Emericella, Empusa,* Empusaceae, *Enantiothamnus, Enarthromyces, Encephalographa, Enchnoa, Enchnosphaeria, Encoelia, Encoeliella, Endobasidium, Endoblastoderma, Endobotrya, Endobotryella, Endocalyx, Endocarpum, Endocena, Endocladis, Endococcus, Endoconidiophora, Endoconidium, Endocoryneum, Endocycia, Endodermophytum, Endodesmia, Endodothella, Endodothiora, Endogloea,* Endogonaceae, *Endogone, Endogonella, Endomyces,* Endomycetaceae, *Endophragmia, Endophyllachora, Endophylloides, Endophyllum, Endoscypha, Endospora, Endostigme, Endothia, Endothiella, Endoxyla, Endoxylina, Endyllium, Englerodothis, Engleromyces, Englerula,* Englerulaceae, *Englerulaster, Enterodictyum, Enterostigma, Enthallopycnidium, Entodesmium, Entoleuca, Entoloma, Entomopatella, Entomophthora, Entomosporium, Entonaema, Entopeltis, Entophlyctis, Entorhiza, Entosordaria, Entyloma, Eocronartium, Eolichen, Eomycenella, Eosphaeria, Eoterfezia, Ephebae, Ephebe, Ephebeia, Ephelidium, Ephelina, Epheliopsis, Epheliopsis, Ephelis, Epibotrys, Epichloe, Epiclinium, Epicoccum, Epicorticium, Epicymatia, Epicyta, Epidermidophyton, Epidermophytum, Epidochiopsis, Epidochium, Epigloea, Epilichen, Epinectria, Epipeltis, Epiphora, Epiphyma, Epipolaeum, Episoma, Episphaerella, Epistigme, Epithele, Epochnium, Eremascus, Eremotheca, Eremothecella, Eremothecium, Erikssonia, Erinella, Erioderma, Eriomene, Eriomenella, Eriomycopsis, Eriopeziza, Eriosphaeria, Eriospora, Eriosporangium, Eriosporella, Eriosporina, Eriothyrium, Erostella, Erostrotheca,* Erysiphaceae, *Erysiphe, Erysiphella, Erysiphopsis, Erysihopsis, Erythrocarpum, Euacanthe, Euantennaria, Eubelonis, Eucantharomyces, Euchaetomella, Eucorethromyces, Eucyphelis, Eudarluca, Eudimeriolum, Euhaplomyces, Eumela,* EumoUisiae, *Eumonoecomyces, Eupelte, Eupropolella, Eupropolis,* Eurotiaceae, *Eurotiella, Eurotiopsis, Eurotium, Euryachora, Eurychasma, Eurytheca, Eustictidae, Euthryptum, Eutorula, Eutorulopsis, Eutypa, Eutypella, Eutypopsis, Euzodiomyces, Everhartia, Evernia, Everniopsis, Exarmidium,* Exascaceae, *Exascus, Excioconis, Excipula,* Excipulaceae, *Excipularia, Excipulella, Excipulina, Exidia, Exidiopsis, Exilospora, Exobasidiopsis, Exobasidium, Exogone, Exophoma, Exosporella, Exosporina, Exosporina, Exosporium, Exotrichum, Fabraea, Fairmania, Fairmaniella, Falcispora, Farlowiella, Farriola, Farysia, Favillea, Favolus, Ferns jonia, Fenestella, Feracia, Ferrarisia, Filoboletus, Fimetaria, Fioriella, Fischerula, Fistulina, Fistulinella, Flageoletia, Flaminia, Flammula, Fleischeria, Fleischhakia, Floccomutinus, Fomes, Fominia, Forssellia, Fouragea, Fracchiaea, Fragosoa, Fragosoella, Fragosphaeria, Friesula, Frommea, Fuckelia. Fuckelina, Fulininaria, Fumago, Fumagopsis, Fumagospora, Fusariella, Fusarium, Fusella. Fusicladiella, Fusicladium, Fusicoccum, Fusicolla, Fusidium, Fusisporella,* I *Fusoma, Gaillardiella, Galactinia, Galera, Gallowaya, Galziiiia, Gambleola, Gamonaemella, Gamospora, Gamosporella, Ganoderma, Gastroboletus, Gautieria, Geaster, Geasteroides, Geasteropsis, Geisleria, Gelatinosporis, Gelatinosporium, Geminispora, Genabea, Genea, Geoglossae, Geoglossum, Geolegnia, Geopora, Geopyxis, Geotrichum, Gerwasia, Gibbera, Gibberella, Gibberidea, Gibellia, Gibellina, Gibellula, Gibsonia, Gilletia, Gilletiella, Gillotia, Giulia, Glaziella, Glenospora, Gliobotrys, Gliocephalis, Gliocladium, Gliocladochium, Gliomastix, Glischroderma, Globaria, Globulina, Gloeocalyx, Gloeocephala, Gloeocystidium, Gloeodes, Gloeoglossum, Gloeopeniophora, Gloeopeziza, Gloeoporus, Gloeosoma, Gloeosphaera, Gloeosporidiella, Gloeosporidina, Gloeosporidium, Gloeosporiella, Gloeosporina, Gloeosporiopsis, Gloeosporium, Gloeothele, Glomerella, Glomerula, Glomerularia, Glomus, Gloniella, Gloniopsis, Glonium, Glossodium, Glutinium, Glycophila, Glyphis, Glypholecia, Gnomonia, Gnomoniella, Gnomonina, Gnomoniopsis, Godfrinia, Godronia, Godroniella, Godroniopsis, Gomphidius, Gomphillus, Gonapodya, Gonatobotrys, Gonatobotrytae, Gonatobotryum, Gonatorhodis, Gonatorhodum, Gongromeriza, Gongylia, Gonisporium, Gonisporiuni, Gonohymenia, Gonolecania, Gonothecis, Gonothecium, Gonyella, Gonytrichum, Goplana, Gorgoniceps, Grallomyces. Grammothele, Grandinia, Grandiniella, Granularia,* Graphidaceae, *Graphidae, Graphidium, Graphina, Graphinella, Graphiola,* Graphiolaceae, *Graphiopsis, Graphiothecium, Graphis, Graphium, Graphyllium, Griggsia, Griphosphaerella, Griphosphaeria, Griphosphaerioma, Groveola, Grubyella, Gueguenia, Guelichia, Guepinia, Guignardia, Guignardiella, Guillermondia, Giiillermondia, Guttularia, Guttularia, Gyalecta, Gyalectae,* Gymnascaceae, *Gymnascales, Gymnascus, Gymnoconia, Gymnoderma, Gymnodochium, Gymnoglossum,* GymnograpHa_ *Gyninomyces, Gymnopeltis, Gymnosporangium, Gymnotelium, Gyrocephalus, Gyroceras,* GyrocoUema, *Gyrocratera, Gyrodon, Gyromitra, Gyrophora, Gyrophorae, Gyrophragmium, Gyrostomum, Gyrostroma,* H *Habrostictis, Hadotia, Hadronema, Hadrotrichum, Haematomma, Haematomyces, Haematomyxa, Hainesia, Halbania, Halbaniella, Halbanina, Halobyssus, Halonia, Halstedia, Hamaspora, Hamasporella, Hansenia, Hanseniospora, Hansenula, Hapalocystis, Hapalophragmium, Hapalosphaeria, Haplaria, Haplariella, Haplariopsis, Haplariopsis, Haplobasidium, Haplodothella, Haplodothis, Haplographium, Haplolepis, Haplomela, Haplomyces,* Haplopeltineae, *Haplopeltis, Haplophyse, Haplopyrenula, Haplopyxis, Haploravenelia, Haplosporangium, Haplosporella, Haplosporidium, Haplosporium, Haplostroma, Haplotheciella, Haplothecium, Haplothelium, Haplotrichum, Haplovalsaria, Haraea, Hariotia, Hariotula, Harknessia, Harknessiella, Harpagomyces, Harpidium, Harpocephalum, Harpochytrium, Harpographium, Harposporella, Hartiella, Hartigiella, Harziella, Hassea, Hebeloma, Helicia, Helicobasidium, Helicobasis, Helicocephalum, Helicodendrum, Helicodesmus, Helicogloea, Helicoma, Helicomyces, Helicopsis, Helicosporangium, Helicosporium, Helicostilbe, Helicostylum, Helicotrichum, Helicoum, Heliomyces, Heliscus, Helminthocarpum, Helminthophana, Helminthosphaeria, Helminthosporium, Helolachnum, Helostroma,* Helotiaceae, *Helotiae, Helotiopsis, Helotium, Helvella,* Helvellaceae, *Helvellae, Hemidothis, Hemigaster, Hemiglossum, Hemileia, Hemileiopsis,* Hemisphaeriaceae, *Hemispora, Hendersonia, Hendersoniella, Hendersonina, Hendersoninula, Hendersoniopsis, Hendersonula, Henningsia, Henningsiella, Henningsina, Henningsomyces, Henriquesia, Heppia, Heppiae, Heptameria, Heptasporium, Hercospora, Hericium, Hermatomyces, Herpobasidium, Herpocladiella, Herpocladium, Herpomyces, Herpothrix,*

TABLE 4-continued

FUNGAL GENERA

*Herpotrichia, Herpotrichiella, Herpotrichiopsis, Heterobasidium, Heterobotrys, Heterobotrys, Heterocarpum, Heterocephalum, Heteroceras, Heterochaete, Heterochaetella, Heterochlamys, Heterodea, Heterodothis, Heteromyces, Heteronectria, Heteropatella, Heteropera, Heterophracta, Heteroplegma, Heterosphaeria, Heterosporium, Hetcrotcxtus, Hexagonella, Hexagonia, Heydenia, Heydeniopsis, Hiatula, Himantia, Hippoperdum, Hirneola, Hirneolina, Hirsutella, Hirundinaria, Histoplasma, Hobsonia, Hoehneliella, Hoehnelogaster, Hoehnelomyces, Holcomyces, Holocoenis, Holocyphis, Holothelis, Holstiella, Holwaya, Holwayella, Homopsella, Homostegia, Hormiactella, Hormiactina, Hormiactis, Honiiisciopsis, Hormiscium, Horniococcus, Hormodendrum, Hormomyces, Hormonema, Hormopeltis, Hormosperma, Hormothecium, Hormylium, Hueella, Humaria, Humariella, Humarina, Husseya, Hyalasterina, Hyalinia, Hyaloceras, Hyalocrea, Hyalocurreya, Hyalodema, Hyaloderma, Hyalodermella, Hyalodictyum, Hyalodothis, Hyalomeliolina, Hyalopeziza, Hyalopsora, Hyalopus, Hyaloria, Hyaloscypha, Hyalosphaera, Hyalotexis, Hyalotheles. Hyalothyris,* Hydnaceae, *Hydnangium, Hydnobolites,* Zll *Hydnochaete, Hydnochaete, Hydnocystis, Hydnodon, Hydnofomes, Hydnotrya, Hydnotryopsis,* m *Hydnum, Hydraeomyces, Hydrogera, Hydroncctria, Hydrophilomyces, Hydrophora, Hydrothyria, Hygrophorus, Hymenella, Hymenobactrum. Hynienoboliis, Hymenochaete, Hymenogaster,* li Hymenogastraceae, *Hymenogramme, Hymenopsis, Hymenoscypha, Hymenula, Hyperomyxa, Hyperphyscia, Hyperus, Hypha, Hyphaster, Hyphochytriinii, Hyphoderma, Hyphodiscus, Hypholoma, Hyphoscypha, Hyphosoma, Hyphostereum, Hypocapnodium, Hypocelis, Hypocenia,* Hypochnaceae, *Hypochnus, Hypocopra, Hypocrea,* Hypocreaceae, *Hypocrella, Hypocreodendrum, Hypocreophis, Hypocreopsis, Hypoderma, Hypodermella, Hypodermellina, Hypodermina, Hypodermina, Hypodermium, Hypodermopsis, Hypogloeum, Hypolyssus, Hypomyces, Hypomycopsis. Hyponectria, Hypoplegma, Hypoplegma, Hypospila, Hypospilina, Hypostegium, Hypostigine, Hypoxylina, Hypoxylopsis, Hypoxylum, Hysterangium,* Hysteriaceae, *Hysteridiuiii, Hysterium, Hysteroglonium, Hysterographium, Hysteromyxa, Hystcropatella, Hysteropeltella, Hysteropeziza, Hysteropezizella, Hysteropsis, Hysteropsis, Hysterostegiella, Hysterostoma, Hysterostomella, Hysterostomina, Icmadophila, Idiomyces, Ijuhya, Ileodictyum, Illosporium, Indiella, Ingaderia, Inocybe, Inocyclus, Inzengaea, lotidea, Irene, Irenina, Irenopsis, Iridionia, Irpex, Isaria, Isariella, Isariopsis, Ischnostroma, Isipinga, Isoachlya, Isomunkia, Isomyces, Isothea, Isthmospora, Itajahya, Ithyphallus, Jaapia, Jackya, Jaczewskia, Jaczewskiella, Jaffuela, Jahniella, Jainesia, Janospora, Janseella, Jansia, Japonia, Jaraia, Jattaea, Jenmania, Johansonia, Jola, Jonaspis, Julella,* K *Kabatia, Kabatiella, Kalchbrennera, Kalmusia, Karschia, Karstenia, Karstenula, Kawakamia, Keissleria, Keissleriella, Keisslerina, Keithia, Kellermannia, Kerminicola, Khekia, Kickxella, Kirschsteinia, Kirschsteiniella, Klastospora, Klebahnia, Kleidiomyces, Kmetia, Kneiffia, Koerberia, Konenia, Konradia, Koordersiella, Kordyana, Kordyanella, Kretschmaria, Kriegeria, Kriegeriella, Kuehneola, KuUhemia, Kunkelia, Kuntzeomyces, Kupsura, Kusanoa, Kusanobotrys, Kusanoopsis, Laaseoniyces, Laboulbenia,* Laboulbeniaceae, Laboulbeniales, *Labrella, Labridium, -accocephalum. Lacellina, Lachnaster, Lachnea, Lachnella, Lachnellula, Lachnocaulum, Lachnocladium, Lachnodochium, Lachnum, Lactaria, Lactariopsis, Lactarius, Laestadia, Laestadiella, Lagena, Lagenidiopsis, Lagenidium, Lageniformia, Lagerheimia, Lagynodella, Lahmia, Lambertella, Lambottiella, Lambro, Lamia, Lamprospora, Lamyella, Langloisula, Lanomyces, Lanopila, Lanzia, Laquearia, Laschia, Lasiella, Lasiobelonis, Lasiobelonium, Lasiobolus, Lasiobotrys, Lasiodiplodia, Lasionectria, Lasiophoma, Lasiosordaria, Lasiosphaera, Lasiosphaeria, Lasiosphaeris, Lasiostemma, Lasiostictis, Lasiostroma, Lasiothyrium, Lasmenia, Lasmeniella, Latrostium, Latzelia, Laurera, Lauterbachiella, Leandria, Lecanactidae, Lecanactis, Lecania, Lecaniascus, Lecanidion, Lecaniopsis, Lecanora, Lecanorae, Lecanosticta, Lecidea,* Lecideaceae, *Lecideae, Lecideopsella, Lecideopsis, Lecidopyrenopsis, Lecioglyphis, Leciographa, Leciophysma, Lecithium, Lecopyrenopsis, Leeina, Leiosepium, Leiosphaerella, Lelujn, Lemalis, Lembosia, Lembosiella, Lembosina, Lembosiodothis, Lembosiopsis, Lemmopsis, Lemonniera, Lempholemma, Lentinus, Lentodiopsis, Lentodium, Lentomita, Lentomitella, Lenzites, Leotia, Leotiella, Lepidella, Lepidocollema, Lepidogium, Lepidoleptogium, Lepiota, Lepolichen, Lepraria, Leprieurina,* LeprocoUema, *Leptascospora, Lepteutypa, Leptinia, Leptobelonium, Leptochlamys, Leptocoryneum, Leptocrca, Leptodermella, Leptodothiora, Leptodothis, Leptogidium, Leptogiopsis, Leptogium, Leptoglossum, Leptographium, Leptolegnia, Leptomassaria, Leptomelanconium, Leptomeliola, Leptomitae, Leptomitus, Leptonia, Leptopeltella, Leptopeltina, Leptopeltis, Leptopeziza, Leptophacidium, Leptophoma, Leptophyma, Leptopuccinia, Leptorhaphis, Leptosacca, Leptosillia, Leptosphaerella, Leptosphaeria, Leptosphaeropsis, Leptosphaerulina, Leptospora, Leptosporella, Leptosporium, Leptosporopsis, Leptostroma,* Leptostromaceae, *Leptostromella, Leptothyrella, Leptothyrina, Leptothyrium, Leptotrema, Leptotrichum, Leptoxyphium, Letendraea, Letharia, Lethariopsis, Leucangium, Lcucobolites, Leucoconis, Leucoconius, Leucocrea, Leucocytospora, Leucodochium, Leucogaster, Leucopaxillus, Leucopezis, Leucophleps, Leucophomopsis, Leucostoma, Leucothyridium, Leveillella, Leveillina, Leveillinopsis, Leveillula, Levieuxia, Libertella, Libertiella, Libertina, Lichenoconium, Lichenopeltella, Lichenophoma, Lichenosticta, Lichenyllium, Lichina, Lichinae, Lichinella, Lichinodium, Lichtheimia, Licopolia, Ligniella, Ligniera, Lilliputia, Limacinia, Limacinia, Limaciniella, Limaciniopsis, Limnaeomyces, Lindauella, Lindauomyccs, Lindauiopsis, T, indrothia, Linearistroma, Linhartia,* Linkiclla, *T. inoboliis, Linocarpum, Linochora, Linochorella, Linodochium, Linospora,* IIT *Linostoma, Linostomella, Linostroma, Linotexis, Lipospora, Lisea, Lisiella, Listeromyces, Lithoecea, Lithographa, Lithothelium, Litschaueria, Lituaria, Lizonia, Lizoniella, Lloydiella, Lobaria, Lobarina, Locellina, Loculistroma, Lo jkania, Lonchospermella, Longia,* ZZl *Longoa, Lopadiopsis, Lopadium, Lopadostoma, Lopharia, Lophidiopsis, Lopliidium, Lophiella, Lophionema, Lophiosphaera, Lophiostoma,* Lophiostomaceae, *Lophiotrema, Lophiotricha, Lophium, Lophodermella, I. ophodermellina, T, ophoderniina, Lophodermium, Lophodermopsis,* ill *Lophophytum, Loramyces, Loranthomyces, Ludwigiella, Lulworthia, Lycogalopsis,* Lycoperdaceae, Lycoperdales, *Lycoperdellon, Lycoperdopsis, Lycoperdum, Lyonella, Lysospora, Lysurus, M Macalpinia, Macbridella, Macowaniella, Macowanites, Macrobasis, Macrochytrium, Macroderma, Macrodiaporthe, Macrodiplis, Macrodiplodia, Macrodiplodiopsis, Macrophoma, Macrophomella, Macrophomina, Macrophomopsis, Macroplodiella, Macropodia, Macroseptoria, Macrospora, Macrosporium, Macrostilbum, Madurella, Magnusia, Magnusiella, Magnusiomyces, Maireella,*

TABLE 4-continued

FUNGAL GENERA

*Malacodermis, Malacosphaeria, Malassezia, Malbranchea, Malmeomyces, Mamiana, Mamianella, Manginia, Manginula, Manilaea, Mapea, Marasniiopsis, Marasmius, Maravalia, Marchalia, Marchaliella, Marcosia, Maronea, Marsonia, Marsoniella, Marsonina, Martellia, Martensella, Martindalia, Martinella, Massalongia, Massalongiella, Massalongina, Massaria, Massariella, Massariellops, Massarina, Massarinula, Massariopsis, Massariovalsa, Masseea, Masseella, Massospora, Mastigocladium, Mastigonema, Mastigonetrum, Mastigosporella, Mastigosporium, Mastodia, Mastomyces, Matruchotia, Mattirolia, Matula, Maublancia, Mauginiella, Maurodothella, Maurodothis, Maurya, Maxillospora, Mazos-a, Mazzantia, Alazzantiella, Medeolaria, Medusomyces, Medusulina, Megalonectria, Megalopsora, Megaloseptoria, Megalospora, Melachroia, Melampsora,* Melampsoraceae, *Melampsorella, Melampsoridium, Melampsoropsis, Melampydium,* Melanconiaceae, Melanconiales, *Melanconiella, Melanconiopsis, Melanconis, Melanconium, Melanidium, Melanobasidium, Melanobasis, Melanobotrys, Melanochlamys, Melanodiscus, Melanogaster, Melanographium, Melanomma, Melanomyces, Melanoplaca, Melanops, Melanopsamma, Melanopsammella, Melanopsammina, Melanopsammopsis, Melanopsichium, Melanosphaeria, Melanospora, Alelanosporopsis, Melanostroma, Melanotaenium, Melanotheca, Melasmia, Melaspilea, Melastiza, Melchiora, Meliola, Meliolaster, Meliolidium, Meliolina, Meliolinopsis, Melioliphila, Meliolopsis, Melittosporiella, Melittosporiopsis, Melittosporis, Melittosporium, Melogramma,* li\ *Melomastia, Melophia, Memnoniella, Mendogia, Menezesia, Menispora, Menoidea, Merarthonis, Meria, Meringosphaeria, Merismatium, Merismella, Merodontis, Merophora, Meroplacis, Merorinis, Merostictina, Merostictis, Merrilliopeltis, Merulius, Mesniera, Mesobotrys, Mesonella, Mesophellia, Mesopsora, Metabotryum, Metacapnodium, Metachora, Metacoleroa, Metadothella, Metameris, Metanectria, Metasphaeria, Metathyriella, Methysterostomella, Metraria, Michenera, Micranthomyces, Micrascus, Microbasidium, Microcallis, Microcera, Microclava, Microcyclella, Microcyclus, Microdiplodia, Microdiscula, Microdiscus, Microdochium, Microdothella, Microglaena, Microgloeum, Microglossum, Micrographa, Micromastia, Micromyces, Micromycopsis, Micromyriangium, Micronectria, Micronectriella, Micronectriopsis, Micronegeria,* Micropeltaceae, *Micropeltella, Micropeltis, Micropeltopsis, Micropera, Microperella, Microphiale, Microphiodothis, Micropodia, Micropsalliota, Micropuccinia, Micropyrenula, Microscypha, Microspatha, Microsphaera, Microsphaeropsis, Microsporella, Microsporum, Microstelium, Microsticta, Microstroma, Microthecium, Microthelia, Microtheliopsis,* Microthyriaceae, Microthyriales, Microthyrieae, *Microthyriella, Microthyriolum, Microthyris, Microthyrites, Microthyrium, Microtyle, Microtypha, Microxyphium, Microxyphiella, Micula, Midotiopsis, Midotis, Milesia, Milesina, Milowia. Mindemella, Minksia, Mitochytridium, Mitochytrium, Mitopeitis, Mitosporium, Mitromyces, Mitrula, Mitruliopsis, Miyabella, Miyagia, Miyakeaniyces, Miyoshia, Miyoshiella, Moelleriella, Moelleroclavus, Moellerodiscus, Moeszia, Moesziella, Mohortia, Molleriella, Molliardia, Mollisia,* MoUisiaceae, *Mollisiella, MoUisiopsis, Monacrosporium,* Monascaceae, *Monascostroma, Monascus, Monilia,* Moniliaceae, Moniliales, *Moniliopsis, Monilochaetes, Monoblastia,* Monoblepharidaceae, *Monoblephariopsis, Monoblepharis, Monochaetia, Monoecomyces, Monogrammia, Monographella, Monographus, Monopodium, Monopus, Monopycnis, Monorhiza, Monorhizina, Monospora, Monosporella, Monosporidium, Monosporiella, Monosporium, Monostichella, Monotospora, Monotrichum, Montagnellina, Montagnina, Montagnites, Montagnula, Montemartinia, Montoyella, Morchella, Morenella, Morenina, Morinia, Moriola, Moriolae, Mortierella, Mortierellae, Moschomyces, Moutoniella, Muchmoria, Muciporus, Mucor,* Mucoraceae, *Mucorae, Mucronella, Mucronoporus, Mucrosporium, Muellerella, Muiaria, Muiogone, Multipatina, Munkia, Munkiella, Munkiodothis, Murashkinskija, Mutinus, Mycaureola, Myceliophthora, Myceloderma, Mycelophagus, Mycena, Mycenastrum, Mycobacidia, Mycobacillaria, Mycobilimbia, Mycoblastus, Mycocalicium, Mycocitrus, Mycocladus, Mycodendrum, Mycoderma, Mycogala, Mycogone, Mycolangloisia, Mycolecidea, Mycolecis, Mycomalus, Mycophaga, Mycopharus,* Mycoporaceae, *Mycoporellum, Mycoporis, Mycoporum, Mycopyrcmila, Mycorhynchella, Mycorhynchus,* Hi *Mycosphaerella, MycosphaercUopsis, Mycosticta, Mycosyrinx,* j\lycotorula, *Mycovellosiella, Myelosperma, Myiocoprella, Myiocoprum, Mylittopsis, Myriadoporus, Myriangella,* Myriangiaceae, *Myriangiae, Myriangina, Myrianginella, Myriangiopsis, Myriangium, Myridium, Myriellina, Myrillium, Myrioblepharis, Myriococcum, Myrioconium, Myrioconiuni, Myriogenis, Myriogenospora, Myriolecis, Myriophysa, Myriophysella, Myriopyxis, Alyriostigina, Myrmaeciella, Myrmaecium, Myrmecocystis, Myrotheciella, Myrothecium, Mystrosporium, Mytilidium, Myxasterina, Myxocyclus, Myxodictyum, Myxodiscus, Myxofusicoccum, Myxolibertella, Alyxomycidium, Myxomyriangis, Myxomyriangium, Myxonema, Myxophacidiella, Myxophacidiuni, Myxormia, Myxosporella, Myxosporina, Myxosporium, Myxotheca, Myxothecium, Myxothyrium, Myxotrichella, Myxotrichum, Myzocytium, Nadsonia, Naegelia, Naeg-eliella, Naemacyclus, Naematelia, Naemosphaera, Nacmosphaerella, Naemospora, Naetrocymbe, Naevia, Naeviella, Napicladium, Napomyces, Naucoria, Naumovia, Necator, Necium, Nectaromyccs, Nectria, Nectriella, Nectriella,* Nectrioidaceae, *Nectriopsis, Negeriella Nemastroma, Nematogonium, Nematospora, Nematosporangium, Nematostigma, Neinatostoma, Nematothecium, Nemozythiella, Neoarcangelia, Neobarclaya, Neobulgaria, Neocosmospora, Neofabraea, Neohendersonia, Neohenningsia, Neoheppia, Neohoehnelia, Neokeissleria, Neolamya, Neolecta, Neoniichclia, Neoncctria, Neopatella, Neopeckia, Neophoma, Neoplacosphaeria, Neoravenelia, Neorehmia, Neosaccardia, Neoskofitzia, Neosphaeropsis, Neostomella, Neotrichophytum, Neotrotteria, Neottiella, Neottiopezis, Neottiospora, Neottiosporella, Neottiosporis, Neovcnturia, Neovossia, Neozimmermannia, Nephlyctis, Nephroma, Nephromium, Nephrommopsis, Nephrospora, Ncpotatiis, Nesolechia, Nidula, Nidularia,* Nidulariaceae, *Nielsenia, Niesslella, Niesslia, Nigropogon, Nigrosphaeria, Nigrospora,, Niorma, Niptera, Nitschkea. Nodulisphaeria, Nolanea, Nomuraea, Normandina, Norrlinia, Nostotheca, Notarisiella, Nothodiscus, Nothoravenelia, Nothospora, Nothostroma, Nowakowskia, Nowakowskiella, Nowellia, Nozcniia, Nummularia, Nyctalis, Nylanderiella, Nynianomyces, Nyssopsora, Nyssopsorella, Obelidium, Ocellaria, Ocellularia, Ochrolechia, Ochropsora, Octaviana, Odontia,* Odontoschi/uin, *Odontotrema, Odontotrcinella, Odontura, Oedemium, Oedocephalum, Oedomyces, Ohleria, Ohleriella, Oidiopsis, Oidium, Oleina, Oleinis, Oligostroina, Olivea, Ollula,* Olpidiaceae, *Olpidiae, Olpidiaster, Olpdiopsis, Olpidium, Olpitrichum, Ombrophila, Omphalia, Omphalospora, Oncopodium, Oncospora, Ontotelium, Onygena,*

TABLE 4-continued

FUNGAL GENERA

Onygenaceae, *Oomyces, Oospora, Oosporidca, Oothecium, Oothecium, Opeasterina, Opeasterinella, Opegrapha, Opethyrium, Ophiobolus, Ophiocapnis, Ophiocapnodium, Ophiocarpella, Ophioceras, Ophiochaeta, Ophiocladium, Ophiodictyum, Ophiodothella, Ophiodothis, Ophiogloea, Ophiognomonia, Ophiomassaria, Ophiomeliola, Ophionectria, Ophiopeltis, Ophiosphaerella, Ophiosphaeria, Ophiostoma, Ophiostomella, Ophiotexis, Ophiotrichum, Oplothecium, Oraniella, Orbicula, Orbilia, Orbiliopsis, Orcadia, Ordonia, Orinathoidium, Orphniospora, Oropogon, Orthoscypha, Oscarbrefeldia, Ostenfeldiella, Ostreionella, Ostreium, Ostropa, Ostropae, Oswaldia, Oswaldina, Otidea, Otidella, Otthia, Otthiella, Oudemansiella, Ovularia, Oxydothis, Ozonium, Pachybasidiella, Pachybasium, Pachydiscula, Pachypatella, Pachyphiale, Pachyphloeus, Pachyrhytisma, Pachyspora, Pachytrichum, Pactilia, Paecilomyces, Paepalopsis, Paidania, Palawania, Palawaniella, Pampolysporium, Panaeolus, Pannaria, Pannariae, Panus, Papularia, Papulospora, Parabotryum, Paracapnodium, Paracesatiella, Paracudonia, Paracytospora, Paradidymella, Paradiplodia, Paralaestadia, Paramazzantia, Paranectria, Paranthostomella, Parapeltella, Parasclerophoma, Parasitella, Parasphaeria, Paraspora, Parasterina, Parastigmatea, Parathalle, Paratheliae, Parathelium, Parendomyces, Parenglerula, Parmelia,* Parmeliaceae, *Parmeliae, Parmeliella, Parmeliopsis, Parmentaria, Parmularia, Parmulariella, Parmulina, Parmulineae, Parodiella, Parodiellina, Parodiopsis, Paropsis, Paryphedria, Passalora, Passeriniella, Passerinula, Patellaria,* Patellariaceae, *Patellea, Patellina, Patellinae, Patellonectria, Patinella, Patouillardia, Patouillardiella, Patouillardina, Pauahia, Paulia, Paurocotylis, Paxillus, Paxina, Pazschkea, Pazschkella, Peccania, Peckia, Peckiella, Pedilospora, Pellicularia, Pellionella, Pelodiscus, Peloronectria, Peltaster, Peltella, Peltidea, Peltidium, Peltigera,* Peltigeraceae, *Peltigerae, Peltigeromyces, Peltistroma, Peltosoma, Peltosphaeria, Peltostroma, Peltostromella, Pemphidium, Peniciliopsis, Penicillium, Peniophora, Peniophorina, Penomyces, Pentagenella, Penzigia, Perforaria, Periaster, Peribotryuin, Perichlamys, Pericladium, Pericoccis, Periconia, Periconiella, Pericystis, Peridermium, Peridoxylum, Periola, Periolopsis, Perischizum,* Perisporiaceae, Perisporiales, *Ierisporiella, Perisporina, Perisporiopsis,* Ierisporiopsis, *Perisporium, Peristemma, Peristomium, Perizomatium, Perizomella, Peroneutypa, Peroneutypella, Peronoplasmopara, Peronospora,* Peronosporaceae, *Peronosporae, Perrotia, Perrotiella, Persooniella, Pertusaria, Pertusariae, Pestalozzia.* Pestalozziella, *Pestalozzina, Petasodes, Petelotia, Petractis, Petrakia, Petrakiella, Peyritschiella,* Peyritschiellaceae, *Peyronelia, Peziotrichum, Peziza,* Pezizaceae, *Pezizae,* Pezizales, *Pezizella, Pezizellaster, Z Pezolepis, Pezoloma, Pezomela, Phacenula,* Phacidiaceae, Phacidiales, *Phacidiella, Phacidina, Phacidiostroma, Phacidium, Phacopsis, Phacopsora, Phaeangella, Phaeangium, Phaeapiospora, Phaeaspis. Phaeharziella, Phaeidium, Phaeisaria, Phaeisariopsis, Phaeobotryosphaeria, Phaeobotryum, Phaeocapnodinula, Phaeochora, Phaeochorella, Phaeociboria, Ihaeoclavulina, Phaeoconis, Phaeocreopsis, Phaeocryptopus, Phaeocyphella, Phaeocytostroma, Phaeoderris, Phaeodiaporthe, Phaeodimeriella, Phaeodimeris, Phaeodiscula, Phaeodomus, Phaeodothiopsis, Phaeodothis, Phaeofabraea, Phaeoglossum, Phaeographina, Phaeographis, Phacoliygrocybe, Phaeolabrella, Phaeolimacium, Phaeomacropus, Phaeomarasniius, Phaeomarsonia, Phaeomarssonia, Phaeomeris, Ihaeoiiionostichella, Phaeopeltis, Phaeopeltis, Phaeopeltium, Phaeopeltosphaeria, Phaeopezia, Phaeophacidium, Phaeophleospora, Phaeophomatospora, Phaeophomopsis, Phaeopolynema, Phaeopterula, Phaeoradulum, Phaeorhytisma, Phaeosaccardinula, Phaeoschiffnerula, Phaeoscutella, Phaeoseptoria, Phaeosperma, Phaeosphaerella, Phaeosphaeria, Phaeospora, Phaeosporis, Phaeostigme, Phaeostigme, Phaeostilbella, Phaeothrombis, Phaeotrabutiella, Phaeotrema, Phaeotremella, Phaeotrype,* Phallaceae, *Phallobata, Phallogaster, Phallus, Phalodictyum, Phalostauris, Phalothrix, Phanerascus, Phanerococcus, Phanerocorynelia, Phanerocorynenm, Phaneroniyces, Phanosticta, Phanotylium, Pharcidia, Pharcidiella, Pharcidiopsis, Phellorina, Phellostroma, Phialea,* Phialophoi-a, IMiillipsia, PhiUipsiella, *Philocopra, Philonectria, Phlebia, Phlebophora, Phleboscyphus, Phlegmophiale, Phleogena, Phleospora, Phloeoconis, Phloeopeccania, Phlocophthora, Phlocosporella, Phlocosporina, Phlyctaena, Phlyctaeniella, Phlyctella, Phlyctidia, Phlyctidium, Phlyctis, Phlyctochytrium, riioenicostronia, Pholiota, Pholiotella, Phoma,* Phomaceae, *Phomachora, Phomales, Phomatospora, Phomatosporopsis, Phomopsina, Phomopsis, Phomyces, Phorcys, Phragmidiella, Phragmidium, Phragmocalosphaeria, Phragmocapnias, Phragmocarpella, Phraginocauma, Phragmodochium, Phragmodothella, Phragmodothidea, Phragmodothis, Phragmonaevia, Phragmopeltis, Phragmopyxine, Phragmopyxis, Phragmoscutella, Phragmosperma, Phragniotelium, Phragmothele, Phragmothyriella, Phragmothyrium, Phragmotrichum, Phthora, Phycascus, Phycodiscis, Phycomyces,* Phycomycetes, *Phycopsis, Phyllachora, Phyllachorae, Phyllachorella, Phyllactinia, Phylliscidium, Phylliscum, Phyllobathelium, Phylloblastia, Phyllobrassia, Phyllocarbon, Phyllocelis, Phyllocelis, Phyllocrea, Phylloedia, Phyllomyces, Phyllonochaeta, Phyllophthalmaria Phylloporina, Phylloporis, Phylloporthe, Phylloporus, Phyllopsora, Phyllopsorae, Phyllosticta, Phyllostictina, Phyllotremella, Phymatodiscus, Phymatosphaeria, Phymatotrichum, Physalacria, Physalospora, Physalosporella, Physalosporina, Physcia,* Physciaceae, *Physcidia, Physma, Physmatomyces, Physoderma, Physopella, Physospora, Physosporella, Phytophthora, Pichia, Picoa, Piersonia, Piggotia, Pila, Pilacre, Pilacrella, Pilaira, Pileolaria, Pilgeriella,* Pilidiel]a, *Pilidium, Piline, Pilobolae, Pilobolus, Pilocratera, Pilophorum, Pilosace, Pilula, Piniina, Pinoyella, Pionnotes, Piptocephalis, Piptostoma, Piptostomum, Pirella, Piricauda, Piricularia, Piringa, Pirobasidium, Pirogaster, Pirostoma, Pirostomella, Pirostomella, Pirottaea, Pisolithus, Pisomyxa, Pistillaria, Pithomyces, Pitya, Pityella, Placasterella, Placidiopsis, Placodiplodia, Placodothis, Placographa, Placonema, Placonemina, Placopeziza, Placophomopsis, Placosoma, Placosphaerella, Placosphaeria, Placostroma, Placothelium, Placothyrium, Plactogene, llacuntium, Placynthium, Plaiorhabdus, Plagiostigme, riagiostoma, Ilagiostomella, Magiostroniella, Ilagiotrema, Plasmodiophora,* Plasmodiophoraceae, *Plasmopara, Plasmophagus,* liatycarpiuni, *Platychora, Platygloea, riatypcltella, Ilatysticta, Platystomum, Plearthonis, Plectania, Plectodiscella, Plectonaemella, Plectopeltis, Plectophoma, Plectophomella, Plectophomopsis, Plectosira, Plectosphaera, Plectosphaerella, Plectospira, Plectothrix, Plenodomus, Plenophysa, Plenotrichum, Plenozythia, Pleochaeta, Pleochroma, Ileococcum, Pleoconis, Pleocouturea, Pieocyta, Pleodothis, Pleogibberella, Pleoglonis, Pleolecis, Pleolpidium, Pleomassaria, Pleomeliola, Pleomelogramma,* lleomeris, *Pleomerium, Pleonectria, Pleopatella, Pleophalis, Pleophragiiiia, Pleopyrenis, Pleoravenelia, Pleorinis, Pleoscutula, Pleosphaeria, Pleosphaeropsis, Pleosphaeropsis,*

TABLE 4-continued

FUNGAL GENERA

*Pleosphaerulina, Pleospilis, Pleospora, Pleosporopsis, Pleostictis, Pleostomella, Pleotrachelus,*
*Plcurage, Pleurascus, Pleuroceras, Pleurocolla, Pleurocybe, Pleurocytospora, Pleurodiscula,*
*Pleuronaema, Pleurophoma, Pleurophomella, Pleurophomopsis, Pleuroplaconema,*
*Pleuroplacosphaeria, Pleurostoma, Pleurostomella, Pieurothecium, Pleurotheliopsis, Pleurothyriella,*
*Pleurothyrium, Pleurotrema, Pleurotus, Plicaria, PHcariella, Plochmopeltideila, Plochmopeltineae,*
*Plochmopeltis, Ploettnera, Plowrightia, Plowrightiella,* Iluriporus, *Pluteolus, Pluteus, Pocillum,*
*Pocosphaeria, Podaleuris, Podaxon, Podocapsa, Podocapsium, Podochytrium, Podocrea, Podonectria,*
*Podophacidium, Podoplaconema, Podosordaria, Podosphaera, Podospora, Podosporiella,*
*Podosporium, Podostictina, Podostroma, Podostroma, Podoxyphium, Poecilosporium, Polhysterium,*
*Polioma, Poliomella, Poliotelium, Polyascomyces, Polyblastia, Polyblastiopsis, Polycarpella,*
*Polychaetella, Polychaetum, Polychaetum, Polychidium, Polyclypeolum, Polycoccum, Polycyclina,*
*Polycyclus, Polydesmus, Polygaster, Polylagenochromatia, Polymorphomyccs, Polynema, Polyopeus,*
*Polyphagus, Polyplocium,* Polyporaceae, *Polyporus, Iolyrhina, Polyrhizum, Polysaccopsis,*
*Polysaccum, Polyscytalum, Polyspora, Polysporidium, Polystictus, Polystigma, Polystigmina,*
*Polystomella,* Polystomellaceae, *Polystomelleae, Polystroma, Polythelis,* Polythelis, *Polythrincium,*
*Polythyrium, Polytrichia, Pompholyx, Poria, Porina, Porinopsis, Porocyphus, Poronia, Poropeltis,*
*Poroptyche, Porostigme, Porothelium, Porphyrosoma, Porterula, Pragmopara, Preussia, Prillieuxia,*
*Prillieuxina, Pringsheimia, Prismaria, Pritzeliella, Proabsidia, Prolisea,* Promycetes, *Pronectria,*
*Prophytroma, Propolidium, Propolina, Propoliopsis, Propolis, Prospodium, Prosthecium,*
*Prosthemiella, Prosthemium, Protascus, Protasia, Proteomyces, Protoachlya, Protoblastenia,*
*Protocalicium,* Protococcales, *Protocoronis, Protocoronospora, Protodontia, Protoglossum,*
*Protohydnum, Protomerulius, Protomyces,* Protomycetaceae, *Protomycopsis, Protopeltis,*
*Protoscypha, Protoscypha, Protostegia, Protothyrium, Protoventuria, Protubera, Psalidosperma,*
*Psalliota, Psammina, Psathyra, Psathyrella, Pseudacolium, Pseuderiospora, Pseudoabsidia,*
*Pseudobalsamia, Pseudobeltrania, Pseudocamptoum, Pseudocenangium, Pseudocercospora,*
*Pseudocytospora, Pseudodiaporthe, Pseudodichomera, Pseudodictya, Pseudodimerium,*
*Pseudodimeriujn, Pseudodiplodia, Pseudodiscosia, Pseudodiscula, Pseudofumago, Pseudogaster,*
*Pseudogenea, Pseudographis, Pseudographium, Pseudoguignardia, Pseudohaplis,*
*Pseudohaplosporella, Pseudohelotium, Pseudoheppia, Pseudohydnotrya, Pseudolachnea,*
*Pseudolecanactis, Pseudolembosia, Pseudolizonia, Pseudolpidiopsis, Pseudolpidium, Pseudomassaria,*
*Pseudombrophila, Pseiidomelasniia, Pseudomeliola, Pseudomicrocera, Pseudomonilia,*
*Pseudomycoderma, Pseudonectria, Pseudoparmelia, Pseudoparodia, Pseudoparodiella, Pseudopatella,*
*Pseudopatellina, Pseudoperis, Pseudoperisporium, Pseudoperonospora, Pseudopeziza,*
*Pseudophacidium, Pseudophoma, Pseudophomopsis, Pseudophyllachora, Pseudophysalospora,*
*Pseudopityella, Pseudoplasmopara, Pseudoplea, Pseudoplea, Pseudoplectania, Pseudopleospora,*
*Pseudopolystigmina, Pseudopuccinia, Pseudopyrenula, Pseudorhynchia, Pseudorhytisma,*
*Pseudosaccharomyces, Pseudosclerophoma, Pseudoseptoria, Pseudosphaerella, Pseudosphaeria,*
*Pseudostegia, Pseudostictis, Pseudothiopsella, Pseudothis, Pseudothyridaria, Pseudotrochila,*
*Pseudotryblidium, Pseudotrype, Pseudotthia, Pseudotthiella, Pseudovalsa, Pseudovularia,*
*Pseudozythia, Psilocybe, Psiloglonium, Psilonia, Psilopezia, Psilospora, Psilosporina, Psilothecium,*
*Psora, Psorella, Psoroglaena, Psorographis, Psoroma, Psoromaria, Psorotheciella, Psorotheciopsis,*
*Psorotichia, Psyllidomyces, Pteridiospora, Pteromyces, Pterophyllus, Pterula, Pterygiopsis,*
*Pterygium, Ptychographa, Ptychopeltis, Puccinia,* Pucciniaceae, Pucciniales, *Pucciniastrum,*
*Pucciniopsis, Pucciniosira, Pucciniospora, Pucciniostele, Puiggariella, Puiggarina, Pullularia,*
*Pulparia, Pulveraria, Punctillum, Pustularia, Puttemannsia, Puttemannsiella, Pycnidiella,*
*Pycnidiostroma, Pycnis, Pycnocarpum, Pycnochytrium, Pycnoderma,. Pycnodothis, Pycnographa,*
*Pycnomma, Pycnopeltis, Pycnosporium, Pycnostemma, Pycnostroma, Pycnostysanus, Pycnothyrium,*
*Pyrertastrum, Pyrenidiae, Pyrenidium, Pyreniella, Pyrenobotrys, Pyrenochaeta, Pyrenochaetina,*
*Pyrenocollema, Pyrenodiscus, Pyrenomyxa, Pyrenopezis, Pyrenopeziza, Pyrenopezizae,*
*Pyrenopezizopsis, Pyrenophora, Pyrenopolyporus,* Pyrenopsidae, *Pyrenopsidium, Pyrenopsis,*
*Pyrenostigme, Pyrenothamnia, Pyrenotheca, Pyrenothrix, Pyrenotrichum, Pyrenotrochila, Pyrenula,*
*Pyrenulae, Pyrenyllium, Pyrgidium, Pyrgillus, Pyrhosorus, Pyronema, Pyronemella, Pythiae,*
*Pythiocystis, Pythiogeton, Pythiomorpha, Pythiopsis, Pythium, Pyxidiophora, Pyxine, Quaternaria,*
*Queletia, Questiera, Rabenhorstia, Rachisia, Raciborskiella, Kaciborskioiiiyces, Racodium,*
*Radaisella, Radulum, Ramalina. Ramalodium, Ramonia, Ramosiella, Ramsbottomia, Ramularia,*
*Ramulariopsis, Raniulariospora, RamularisphaercIla, Ramulaspera, Rainulispora, Ranojevicia,*
*Ravenelia, Ravenelula, Readerella, Rebentischia, Reessia, Rehniiella, Rehmiellopsis, Rehmiodothis,*
*Rehmiomyces, Reinkella,* "IC *Resticularia, Reyesiella, Rhabdium, Rhabdocline, Rhabdogloeopsis,*
*Rhabdogloeum, Rhabdopsora, Rhabdospora, Rhabdostroma, Rhabdostromella, Rhabdostromellina,*
*Rhabdostromina, Rhabdothyrella, Rhabdothyrium, Rhachomyces, Rhacodiella, Rhacodium,*
*Rhacophyllus, Rhadinomyces, Rhagadolobium, Rhagadostoma, Rhamphoria, Rhamphospora,*
*Rhaphidisegestria, Rhaphidocyrtis, Rhaphidophora, Rhaphidopyris, Rhaphidospora, Rhaphidyllis,*
*Rheumatopeltis, Rhinocladium, Rhinotrichum, Rhipidium, Rhipidocarpum, Rhizalia, Rhizidiocystis,*
*Rhizidiomyces, Rhizidium, Rhizina, Rhizinae, Rhizocalyx, Rhizocarpum, Rhizoclosmatium,*
*Rhizoctonia, Rhizogene, Rhizohypha, Rhizomorpha, Rhizomyces, Rhizomyxa, Rhizophidium,*
*Rhizophlyctis, Rhizophoma, Rhizopogon, Rhizopus, Rhizosphaera, Rhizosphaerella, Rhizotexis,*
*Rhizothyrium, Rhodobolites, Rhodochytrium, Rhodocybe, Rhodomyces, Rhodopaxillus,*
*Rhodoseptoria, Rhodosticta, Rhodothrix, Rhodotorula, Rhodotus, Rhombostilbella, Rhopalidium,*
*Rhopalocystis, Rhopalomyces, Rhopographella, Rhopographina, Rhopographus, Rhymbocarpus,*
*Rhynchodiplodia, Rhynchomelas, Rhynchomeliola, Rhynchomyces, Rhynchomyces, Rhynchonectria,*
*Rhynchophoma, Rhyncophoromyces, Rhynchophorus, Rhynchosphaeria, Rhynchosporium,*
*Rhynchostoma, Rhynchostomopsis, Rhyparobius, Rhysotheca, Rhytidenglerula, Rhytidhysterium,*
*Rhytidopeziza, Rhytisma, Rhytismella, Riccoa, Richonia, Rickia, Rickiella, Riessia, Rimbachia,*
*Rinia, Rinodina, Robergea, Robertomyces, Robillardia, Robledia, Roccella, Roccellae, Roccellaria,*
*Roccellina, Roccellographa, Rodwaya, Roesleria, Roestelia, Rollandina, Romellia, Rosellinia,*
*Rosenscheldia, Rosenscheldiella, Rostkovites. Rostrella, Rostronitschkea, Rostrosphaeria, Rostrupia,*
*Rotaea, Rotularia, Roumegueria, Roumegueriella, Roussoella, Rozella, Rozites, Ruhlandlella,*
*Russula, Rutstroemia, Sabourauditcs, Saccardaea, Saccardia, Saccardiae, Saccardinula, Saccardoella,*

TABLE 4-continued

FUNGAL GENERA

*Saccardomyces, Saccharomyces,* Saccharomycetaceae, *Saccharomycodes, Saccharomycopsis, Saccoblastia, Saccobolus, Saccomyces, Saccothecium, Sachsia, Sacidium, Sagediopsis, Sagiolechia, Saitomyces, Samarospora, Sampaioa, Santiella, Saprolegnia,* Saprolegniaceae, *Saprolegniae, Sapromyces, Sarcinella, Sarcinodochium, Sarcinomyces, Sarcographa, Sarcographina, Sarcomyces, Sarcophoma, Sarcopodium, Sarcopyrenia, Sarcoscypha, Sarcosphaera, Sarcosoma, Sarcotrochila, Sarcoxylum, Sarophorum, Sartorya, Scaphidium, Scelobelonium, Scenomyces, Sceptromyces, Schenckiella, Schiffnerula,* Schin/.ia, *Scliinzinia, Schismatomma, Schistodes, Schistophorum, Schizachora, Schizacrospernnim, Schizocapnodium, Schizonella, Schizoparme, Schizopelte, Schizophyllum, Schizosaccharis, Schizosaccharomyces, Schizospora, Schizostege, Schizostoma, Schizothyrella, Schizothyrioma, Schizothyrium, Schizotrichum, Schizoxylum, Schneepia, Schoenbornia, Schroeterella, Schroeteria, Schroeteriaster, Schulzeria, Schwanniomyces, Schweinitziella, Sciodothis, Scirrhia, Scirrhiachora, Scirrhiella, Scirrhiopsis, Scirrhodothis, Scirrhophragma, Sclerangium, Sclerochaeta, Sclerochaetella, Sclerococcum, Sclerocystis, Sclerodcpsis, Scleroderma, Scleroderris, Sclerodiscus, Sclerodothiorella, Sclerodothis, Sclerographis, Sclerographium, Scleromeris, Sclerophoma, Sclerophomella, Sclerophomina, Sclerophytum, Scleroplea, Scleroplella, Scleropycnium, Sclerosphaeropsis, Sclerospora, Sclerostagonospora, Sclerotelium, Sclerotheca, Sclerothyrium, Sclerotinia, Sclerotiomyces, Sclerotiopsis, Sclerotium, Scodellina, Scolecactis, Scoleciocarpus, Scolecobasis, Scolecoccoidea, Scolecodothis, Scolecodothopsis, Scoleconectria, Scolecopeltidella, Scolecopeltidium, Scolecopeltis, Scolecopeltium, Scolecopeltopsis, Scolecosporiella, Scolecotrichum, Scolecozythia, Scoliciosporium, Scolionema, Scopinella, Scopophoma, Scoptria, Scopularia, Scopulariopsis, Scorias, Scoriomyces, Scortechinia, Scutellinia, Scutellum, Scutula, Scutularia, Scutellinia, Scutelliniae, Scyphospora, Scyphostroma, Scytopezis, Sebacina, Secotium, Seismosarca, Selenophoma, Selenophomopsis, Selenotila, Selinia, Semigyalecta, Sepedonium, Septobasidium, Septochora, Septocladia, Septocylindrium, Septocyta, Septocytella, Septodothideopsis, Septogloeum, Septoideum, Septomazzantia, Septomyxa, Septonema, Septopatella, Septorella, Septoria, Septoriella, Septoriopsis, Septorisphaerella, Septosporium, Septothyrella, Septotrullula, Sepultaria, Setchellia, Setella, Seuratia, Seynesia, Seynesiola, Seynesiopsis, Shearia, Shiraia, Shropshiria, Sigmatomyces, Sigmoidomyces, Sillia, Simblum, Simonyella, Siphonaria, Siphula, Sirentyloma, Sirexcipula, Sirexcipulina, Siridiella, Siridina, Siridium, Sirobasidium, Sirococcus, Sirocyphis, Sirodesmium, Sirodiplospora, Sirodochiella, Sirodothis, Sirogloea, Sirolegniella, Sirolpidium, Siropatella, Sirophoma, Siroplaconema, Siroplaconema, Siroscyphella, Siroscyphellina, Sirosperma, Sirosphaera, Sirospora, Sirosporium, Sirostromella, Sirothecium, Sirothyriella, Sirothyrium, Sirozythia, Sirozythiella, Sistotrema, Skepperia, Skepperiella, Skierkia, Skottsbergiella, Smeringomyces, Solanella, Solenia, Solenodonta, Solenoplea, Solenopsora, Solorina, Solorinella, Sommerstorffia, Sordaria, Sorica, Sorodiscus, Sorokinia, Sorolpidium, Sorosphaera, Sorosporium, Sorothelia, Sparassis, Spathularia, Spegazzinia, Spegazzinula, Spermatoloncha, Spennodennia, Spennophthora, Sphacelia, Sphaceliopsis, Sphacelotheca, Sphaerella, Sphaerellothecium,* Sphaeriaceae, *Sphaeriales, Sphaericeps, Sphaeridium, Sphaeriostromella, Sphaeriothyrium, Sphaerita, Sphaerobolus, Sphaerocista, Sphaerocolla, Sphaerocreas, Sphaeroderma, Sphaerodermella, Sphaerodes, Sphaerodothis, Sphaerognomonia, Sphaerographium, Sphaeromyces, Sphaeronema, Sphacronemella, Sphaeronemina, Sphaeronemopsis, Sphaeropezia, Sphaerophoma, Sphaerophoropsis, Sphaerophorus, Sphaerophragmium, Sphaeropsis, Sphaerosoma, Sphaerospora, Sphaerosporium, Sphaerostilbe, Sphaerostilbella, Sphaerotheca, Sphaerothyrium, Sphaerulina, Sphaleromyces, Spheconisca, Sphenospora, Sphinctrina, Sphinctrinopsis, Spicaria, Spicularia, Spilodochium, Spilomium, Spilomyces, Spilonema, Spilopezis, Spilopodia, Spilosticta, Spinalia, Spinellus, Spira, Spiralia, Spirechina, Spirogramma, Spirographa, Spirogyrales, Spirospora, Spolverinia, Spondylocladium, Spongospora, Sporendonema, Sporhelminthiuni, Sporobolomyces, Sporoclema, SporoctcJmorpha, Sporocybe, Sporocystis, Sporoderma, Sporodesmium, Sporodictyum, Sporodinia, Sporodiniopsis, Sporomega, Sporomyxa, Sporonema, Sporophlyctis, Sporophysa, Sporopodium, Sporormia, Sporormiella, Sporoschisma, Sporostachys, Sporotrichella, Sporotrichum, Spragueola, Spumatoria, Squamotubera, Stachybotryella, Stachybotrys, Stachylidium, Stagonopatella, Stagonopsis, Stagonospora, Stagonosporopsis, Stagonostroma, Stagonostromella, Staheliomyces, Stalagmites, Stamnaria, Starbaeckia, Starbaeckiella, Staurochaeta, Stauronema, Staurophoma, Staurothele, Steganopycnis, Steganosporium, Stegasphaeria, Stegastroma, Stegia, Stegopeziza, Stegopezizella, Stegophora, Stegothyrium, Steinera, Stella, Stemmaria, Stemphyliomma, Stemphyliopsis, Stemphyliopsis, Stemphylium, Stenocarpella, Stenocybe, Stephanoma, Stephanospora, Stephanotheca, Stephensia, Stereocaulum, Stereochlamys, Stereocrea, Stereolachnea, Stereostratum, Stereum, Sterigmatocystis, Sterile Mycelia, Stevensea, Stevensiella, Stevensula, Stichodothis, Stichomyces, Stichopsora, Stichospora, Sticta, Stictae,* Stictidaceae, *Stictina, Stictinae, Stictis, Stictochorella, Stictochorellina, Stictoclypeolum, Stictopatella, Stictophacidium, Stictostroma, Stigeosporium, Stigmatea, Stigmateae, Stigmatella, Stigmatodothis, Stigmatomyces, Stigmatopeltis, Stigmatophragmia, Stigmatopsis, Stigme, Stigmella, Stigmina, Stigmochora, Stigmopeltella,* Zld *Stigmopeltis, Stigmopsis,* Stilbaceae, *Stilbella, Stilbochalara, Stilbocrea, Stilbodendrum, Stilbohypoxylon, Stilbomyces, Stilbonectria, Stilbopeziza, Stilbospora, Stilbothamnium, Stilbum, Stirochaete, Stomatogene, Stomiopeltella, Stomiopeltis, Strasseria, Streptotheca, Streptothrix, Strickeria, Strigula, Strigulae, Strobilomyces, Stromatiiiia, Stromatographium, Stroinatostysanus, troninc, Stropharia, Strossmayera, Strumella, Strumellopsis, Stuartclla, Stylina, Stylobatcs, Stylonectria, Stypella, Stypinella, Stysanopsis, Stysanus, Subiilariella, Subulicola, Succinaria, Suilliis, Sydowia, Sydowiella, Sydowina, Sydowinula, Symphaeophyma, Symphaster, Symphyosira, Symplectromyces, Synalissa, Synarthonia, Syncarpella, Syncephalastrum, Syncephalidae, Syncephalis, Synchactophagus.* Synchytriaceae, *Synchytrium, Syncsiella, Synesiopeltis, Synglonium, Synnematium, Synomyces, Synostomella, Synpeltis, Synsporium, Syntexis, Synthctospora, Systremma, Systrcmmopsis, Syzygitcs, Taeniophora,* Tang!clla, *Tapellaria, Tapesia, . Taphridium, Taphrina, Tarichiuni, Tarzetta, Tassia, Teichospora, Teichosporella, Telcutospora, Telimena, Tcloconia, Tclospora, Tcphrosticta, reratomyces, Teratonema, Teratosperma, Teratosphaeria, Terfezia, Terfeziopsis, Termitaria, Testicularia, Testudina, Tetrachia, Tetrachytriuin, Tetracium, Tetracladium, Tetracoccosporis, Tetracoccosporium, Tetramyxa, Tetraploa, Thalassoascus, Tlialassomyces, Thallochaete, Thalloedema, Thamnidium,*

TABLE 4-continued

| FUNGAL GENERA |
|---|
| *Thamnocephalis, Thamnolia, Thamnomyces, Thaxteria, Thaxteriella, Thecaphora, Thcciopcltis, Thecopsora, Thecostroma, Thecotheus, Theissenia, Theissenula, Thelebolus, Thelenidia, Thelephora,* Thelephoraceae, *Thelidiopsis, Thelidium, Thelis, Thelocarpum, Thcloporus, Thelopsis, Theloschistes, Thelospora, Thelotrema, Thermoidium, Thcrnioniyccs, Thermutis, Thcrrya, Thielavia, Thielaviopsis, Tholurna, Thoracella, Thozetia, Thrauste, Thraustotheca, Thrombium. Thuemenella, Thwaitesiella, Thyrea, Thyriascus, Thyridaria, Thyridella, Thyridium, Thyrinula, Thyriopsis, Thyriostoma, Thyriostroiiia, Thyrococciim, Thyrodochium, Thyronectria, Thyronectroidea, Thyrosoma, Thyrospora, Thyrostroma, Thyrostromella, Thyrsidiella, Thyrsidina, Thyrsidium, Thysanopyxis, Thysanothecium, Tiarospora, Tiarosporella, Tichospora, Tichosporella, Ti Tichothecium, Tieeheniella, TilachlidioDsis. Tilachlidium, Tilletia,* Tilletiaceae, *Tilotus, Tirmania, Titaea, Titaeospora, Titaeosporina, Titanella, Titania, Tibodasia, Togninia, Tolypomyria, Tolyposporella, Tolyposporium, Tomasiella, Tomentellina, Tonduzia, Toninia, Topospora, Torrendia, Iorrcndiclla, Torrubiella, Torscllia, Torula, Torula, Torulina, Toruloidea, Torulopsis, Torulospora, Toxosporium, Trabuticlla, Trachysphaera, Trachyspora, Tracbysporella, Trachythyriolum, Trachyxylaria, Tracya, Tracyella, Trailia, Trailia, Trametes, Tranzschelia, Traversoa, Treleasia, Treleasiella, Trematophoma, Trematosphaerella, Trematosphaeria, Trematosphaeriopsis, Trematosphaeris, Treinatovalsa, Tremella,* Tremellaceae, Tremellales, *Tremellidium, Tremellodendrum, Tremellodon, Tremellogaster, Tremellopsis, Tremotylium, Treubiomyces, Triactella, Tricella, Trichaegum, Trichaleurina, Trichaleuris, Tricharia, Tricharia, Trichaster, Trichasterina, Trichobacidia, Trichobelonium, Trichobotrys, Trichochora, Trichococcinus, Trichocladium, Trichocollonema, Trichocoma, Trichoconis, Trichocrea, Trichoderma, Trichodiscula, Trichodochium, Trichodothis, Trichodytes, Trichofusarium, Trichoglossum, Trichohleria, Tricholoma, Trichomerium, Trichonectria, Trichopelteae, Trichopeltella, Trichopeltina, Trichopeltis, Trichopeltium, Trichopeltopsis, Trichopeltula, Trichopeltulum, Trichophila, Trichophyma, Trichophytum, Trichopsora, Trichoscypha, Trichoseptoria, Trichosperma, Trichospermella, Trichosphaerella, Trichosphaeria, Trichosporina, Trichosporium, Trichosterigma, Trichostronia, Trichothallus, Tricliotheca, Trichothecium, Trichothelium,* Trichothyriaceae, *Trichothyriella, Trichothyriopsis, Trichothyrium, Trichotrema, Trichurus, Tridens, Triglyphium, Trigonosporium, Trimmatostroma, Trimmatothele, Trinacrium, Triphragmiopsis, Triphragmium, Triplicaria, Tripospermum, Tripospora, Triposporina, Triposporium, Trochila, Trochodium, Trogia, Tromcra, Troposporella, Troposporium, i Trotteria, Trotterula, Trullula, Tryblidaria,* Tryblidiaceae, *Tryblidiella, Tryblidiopsis, Tryblidiopycnis, Tryblidis, Tryblidium, Tryblis, Trypetheliae, Trypethelium, Tubaria, Tuber,* Tuberaceae, Tuberales, *Tubercularia,* Tuberculariaceae, *Tiibcrcularielia, Tiibcrculariopsis, Tubercularis, Tuberculina, Tuberculis, Tubeufia, Tuburcinia, Tulasnella, Tylophilus, Tylophorella, Tylophorum, Tylostoma, Tympanis, Tympanopsis, Typhula, Typhulochaeta, Tyridiomyces,* U *Ulcodolliclla, Ulcodothis, Uleomyccs, Uleopeltis, Uleothyrium, Ulocolla, Umbilicaria, Uncigera, Uncinula, Underwoodia, Unguicularia, Unguiculariopsis, Uredinopsis, Uredo, Urnula, Urobasidium, Uroconis, Urocystis, Lrohcndersonia, Uromyces, Uromycladium, Uromycopsis, Urophiala, . Urophlyctis, Uropolystigma, Uropyxis, Urospora, Urosporella, Urosporium, Usnea, Usneae,* Ustilaginaceae, Ustilaginales, *Ustilaginodes, Ustilago, Ustilagopsis, Ustulina, Valdensia, Valetoniella, Valsa, Valsaria, Valsella, Valseutypella, Valsonectria, Vanderystiella, Varicellaria, Varicosporium, Vasculomyces,* Vaucheriales, yi *Velloziella, Velutaria, Venturia,* U *Venturiella, Vermicularia, Vermiculariella, Verpa, Verrucaria,* Verrucariaceae, *Verrucariae, Verrucaster, Verticicladium, Verticilliae, Verticillidochium, Verticilliopsis, Verticillis, Verticillium, Vestergrenia, Vialaea, Vibrissea, Virgaria, Vittadinula, Vivianella, Vizella, Voeltzknowiella, Volkartia, Volutena, Volutellaria, Volutellis, Volutellopsis, Volutellopsls, Volutina, Volvaria, Volvariella, Volvoboletus, Vouauxiella,* W *Wageria, Wallrothiella, Wardina, Wardomyces, Wawelia, Wecsea, Wegelina, Weinmannodora, Wentiomyces, Wettsteinina, Wiesnerina, Wiesneriomyces, Willeya, Williopsis, Winterella, Winterina, Winteromyces, Wojnowicia, Wolkia, Woodiella, Woronina, Woroninae, Woroninella, Wynnea, Wynnella, Xanthocarpia, Xanthopsora, Xanthopyrenia, Xanthoria, Xenodochus, Xenodomus, Xenogloea, Xenolophium, Xenomeris, Xenomyces, Xenonectria, Xenopeltis, Xenopus, Xenosphaeria, Xenosporella, Xenosporium, Xenostele, Xenostroma, Xenothccium, Xerotus, Xiphomyces, Xylaria, Xylariodiscus, Xylobotryum, Xyloceras, Xylocladium, Xylocrea, Xyloglyphis, Xylogramma, Xylographa, Xyloma. Xylopodium, Xyloschistes, Xyloscbizuin, Xylostroma, Xystozukalia, Yatesula, Yoshinagaia, Yoshinagamyces, Yoshinagella, Ypsilonia, Zaghouania, Zahlbrucknerella, Zignoella, Zimmermanniella, Zodiomyces, Zonosporis, Zoophagus, Zopfia, Zopfiella, Zukalia, Zukalina, Zukaliopsis, Zukaliopsis, Zygochytrium, Zygodesmella, Zygodesmus, Zygorhizidium, Zygosaccharis, Zygosaccharomyces, Zygosporium, Zythia,* and Zythiaceae. |

TABLE 5

| FUNGAL ENDOPHYTES |
|---|
| *Acidomyces acidophilus, Acremonium alternatum, Acremonium pteridii, Acremonium strictum, Acrodictys elaeidicola, Acrostalagmus luteoalbus, Albatrellus higanensis, Albonectria rigidiuscula, Alternaria alternata, Alternaria arborescens, Alternaria conjuncta, Alternaria helianthi, Alternaria longipes, Alternaria malorum, Alternaria metachromatica, Alternaria oregonensis, Alternaria photistica, Alternaria protenta, Alternaria tenuissima, Alternaria triticina, Alternaria zinniae, Amorphotheca resinae, Ampelomyces humuli, Anthostomella proteae, Apiognomonia errabunda, Aposphaeria populina, Arthrinium sacchari, Aspergillus aculeatus, Aspergillus niger, Aspergillus versicolor, Athelia bombacina, Aureobasidium pullulans, Bartalinia laurinia, Bartalinia pondoensis, Bartalinia robillardoides, Beauveria bassiana, Bionectria ochroleuca, Bipolaris papendorfii, Boeremia exigua* var. *exigua, Botryosphaeria rhodina, Botrytis cinerea, Brachysporium nigrum, Cadophora (Phialophora) finlandica, Camarosporium palliatum, Camarosporium propinquum, Candida* |

TABLE 5-continued

FUNGAL ENDOPHYTES

*tropicalis, Capnodium coffeae, Ceratobasidium cornigerum, Ceratobasidium obscurum, Cercophora terricola, Chaetomium globosum, Chaetomium sphaerale, Chaetosphaeria endophytica, Chaetosphaeria ovoidea, Chaunopycnis alba, Chaunopycnis pustulata, Chloridium phaeosporum, Chloridium preussii, Chromelosporium fulvum, Cladorrhinum bulbillosum, Cladosporium cladosporioides, Cladosporium edgeworthrae, Cladosporium herbarum, Cladosporium orchidis, Cladosporium oxysporum, Cladosporium tenuissimum, Clonostachys rosea, Clonostachys rosea f. catenulate, Cochliobolus australiensis, Cochliobolus geniculatus, Cochliobolus hawaiiensis, Cochliobolus lunatus, Cochliobolus tuberculatus, Colletotrichum acutatum, Colletotrichum capsici, Colletotrichum crassipes, Colletotrichum dematium, Colletotrichum gloeosporioides, Colletotrichum magna, Colletotrichum musae, Colletotrichum orbiculare, Colletotrichum truncatum, Coniella minima, Coniochaeta tetraspora, Coniochaeta velutina, Coniophora puteana, Coprinellus disseminates, Coprinellys radians, Cordyceps sinensis, Corynascus kuwaitiensis, Corynespora cassiicola, Crinipellis roreri, Cryphonectria parasitica, Cryptococcus victoriae, Curvularia affinis, Curvularia oryzae, Curvularia senegalensis, Curvularia sichuanensis, Cytosphaera mangiferae, Cytospora eucalypticola, Daldinia eschscholzi., Davidiella tassiana, Debaryomyces hansenii, Deightoniella torulosa, Diaporthe cynaroidis, Diaporthe eres, Diaporthe helianthi, Diaporthe phaseolorum, Dictyochaeta triseptata, Dothiorella aromatica, Dothiorella dominicana, Drechslera ellisii, Elsinoe veneta, Embellisia eureka, Emericella nidulans, Engyodontium album, Epicoccum nigrum, Epulorhiza anaticula, Epulorhiza repens, Eurotium amstelodami, Exserohilum rostratum, Fasciatispora petrakii, Fimetariella rabenhorstii, Fomes fomentarius, Fomes fomentarius, Fomitopsis ostreiformis, Fomitopsis pinicola, Fusarium anthophilum, Fusarium aquaeductuum, Fusarium avenaceum, Fusarium bulbicola, Fusarium chlamydosporum, Fusarium culmorum, Fusarium equiseti, Fusarium incarnatum, Fusarium lichenicola, Fusarium moniliforme, Fusarium oxysporum, Fusarium poae, Fusarium polyphialidicum, Fusarium proliferatum, Fusarium pulverosum, Fusarium semitectum var. majus, Fusarium solani, Fusarium sporotrichioides, Fusarium tricinctum, Fusarium verticillioides, Fusicladium britannicum, Ganoderma tsugae, Geomyces vinaceus, Gibberella avenacea, Gibberella baccata, Gibberella fujikuroi, Gibberella moniliformis, Gibberella zeae, Gliomastix murorum, Glomerella cingulata, Glomerella cingulate, Guignardi bidwelli, Guignardia camelliae, Guignardia citricarpa, Guignardia cocoicola, Guignardia mangiferae, Guignardia manqiferae, Guignardia vaccinii, Haematonectria haematococca, Haplotrichum minitissimum, Helgardia anguioides, Helminthosporium chlorophorae, Hypocrea virens, Hypoxylon fragiforme, Hypoxylon serpens, Hypoxylon stygium, Idriella amazonica, Idriella asaicola, Idriella euterpes, Idriella licualae, Ilyonectria radicicola, Kabatiella caulivora, Kluyveromyces marxianus, Kretzschmaria deusta, Lasiodiplodia pseudotheobromae, Lasiodiplodia theobromae, Laspora coronate, Leiosphaerella cocöes, Lentinus squarrosulus, Lepteutypa cupressi, Leptosphaeria coniothyrium, Leptosphaerulina trifolii, Letendraeopsis palmarum, Leucostoma niveum, Lewia eureka, Lewia eureka, Lunulospora curvula, Macrophomina phaseolina, Malbranchea circinata, Massarina arundinariae, Melanospora zamiae, Melanotus subcuneiformis, Melanotus subcuneiformis, Microascus cinereus, Minimidochium setosum, Moniliopsis anomala, Monodictys levis, Morchella elata, Mortierella alpine, Mucor fragilis, Mucor racemosus, Muscodor albus, Mycena murina, Mycocentrospora acerina, Myriangium duriaei, Nectria haematococca, Nemania aenea, Nemania bipapillata, Nemania serpens, Neofusicoccum mangiferae, Neotyphodium lolii, Neurospora crassa, Nigrospora oryzae, Nigrospora sphaerica, Nodulisporium* anamorph of *Hypoxylon fragiforme, Nodulisporium* anamorph of *Hypoxylon fuscum, Nodulisporium gregarium, Ochrocladosporium elatum, Ophiocordyceps sobolifera, Ophiostoma stenoceras, Oxydothis poliothea, Paecilomyces formosus, Papulosa amerospora, Paraconiothyrium minitans, Paraphaeosphaeria quadriseptata, Penicillium biourgeianum, Penicillium brevicompactum, Peniophora cinerea, Periconia* anamorph of *Didymosphaeria igniaria, Periconia digitata, Periconia hispidula, Periconia prolifica, Pestalotiopsis adusta, Pestalotiopsis caudata, Pestalotiopsis guepinii, Pestalotiopsis maculiformans, Pestalotiopsis microspora, Pestalotiopsis palmarum, Pestalotiopsis versicolor, Petriella sordida, Peziza varia, Peziza vesiculosa, Phaeangium lefebvrei, Phaedothis winteri, Phaeomoniella chlamydospora, Phaeotrichoconis crotalariae, Phanerochaete affinis, Phanerochaete sordida, Phialemonium dimorphosporum, Phlebia radiate, Phlogicylindrium eucalypti, Phoma glomerata, Phoma herbarum, Phoma leveillei, Phoma moricola, Phoma radicina, Phoma sorghina, Phoma subglomerata, Phoma tracheiphila, Phoma tropica, Phomatospora bellaminuta, Phomatospora berkeleyi, Phomopsis anacardii, Phomopsis casuarinae, Phomopsis leptostromiformis, Phomopsis mangiferae, Phomopsis manilkarae, Phomopsis orchidophila, Phyllosticta capitalensis, Phyllosticta colocasiicola, Phyllosticta minima, Phyllosticta sapotae, Piptarthron macrosporum, Piricauda pelagica, Piriformospora indica, Plagiostoma euphorbiae, Plenodomus fuscomaculans, Pleurophoma cava, Pleurotus ostreatus, Podospora fimbriata, Porosphaerella borinquensis, Preussia mediterranea, Preussia minima, Pseudocercospora punicae, Pseudocochliobolus pallescens, Pycnoporus cinnabarinus, Pycnoporus sanguineus, Pyriculariopsis parasitica, Ramichloridium apiculatum, Ramichloridium biverticillatum, Rhizopus stolonifer, Rhizopycnis vagum, Rhizosphaera kalkhoffii, Rhodotorula minuta, Schizophyllum commune, Scolecobasidium terreum, Scolicotrichum musae, Scopuloides hydnoides, Scytalidium lignicola, Sebacina vermifera, Septoria anacardii, Setosphaeria rostrata, Sordaria fimicola, Sordaria tomento-alba, Sporormiella minima, Stagonosporopsis dorenboschii, Stemphylium botryosum, Stemphylium solani, Stilbohypoxylon quisquiliarum var. quisquiliarum, Streptomyces albosporus, Streptomyces aureus, Streptomyces cinereus, Streptomyces glaucus, Streptomyces globisporus, Streptomyces griseofuscus, Streptomyces griseorubroviolaceus, Streptomyces hygroscopicus, Streptomyces roseosporus, Sydowia polyspora, Talaromyces flavus, Talaromyces ohiensis, Talaromyces ohiensis, Tetracladium furcatum, Thanatephorus cucumeris, Thanatephorus pennatus, Thermomyces lanuginosus, Thumenella cubispora,*

TABLE 5-continued

FUNGAL ENDOPHYTES

*Torula herbarum* f. *quaternella, Trametes hirsuta, Trematosphaeria pertusa, Trichoderma hamatum, Trichoderma harzianum, Trichoderma koningii, Trichoderma longibrachiatum, Trichoderma viride, Trichothecium roseum, Triscelophorus acuminatus, Triscelophorus konajensis, Triscelophorus monosporus, Truncatella angustata, Truncatella conorum-piceae, Tulasnella calospora, Ulocladium atrum, Ulocladium cucurbitae, Ustilago williamsii, Valsa ceratosperma, Verruculina enalia, Verticillium lecanii, Wiesneriomyces laurinus, Wrightoporia tropicalis, Xylaria acuta, Xylaria adscendens, Xylaria allantoidea, Xylaria anisopleura, Xylaria arbuscula, Xylaria castorea* Berk., *Xylaria coccophora, Xylaria cubensis, Xylaria curta, Xylaria hypoxylon, Xylaria microceras, Xylaria multiplex, Xylaria obovata, Xylaria palmicola, Xylaria telfairii, Zalerion maritimum, Zygosporium echinosporum,* and *Zygosporium gibbum.*

TABLE 6

GROWTH MEDIA
Common media for the growth of microbes bacteria

| Microbe Type | Media | Organisms |
|---|---|---|
| Bacteria | Nutrient Peptone Agar | Heterotrophic bacteria |
| | MacConkey Agar + myo-inositol + Carbenicillin | *Klebsiella* Sp. |
| | J agar | *Bacillus* sp. and other firmicutes |
| | N-poor Medium (LGT) | Aerobic heterotrophic N2-fixing bacteria |
| | Yeast Mannitol Agar | *Rhizobium* sp. |
| | King's B medium | *Pseudomonas* sp. |
| | SC medium | Fastidious bacteria |
| | R2A agar | Oligotrophic bacteria |
| | Tryptic Soy Agar | Heterotrophic bacteria |
| Fungi | Cornmeal agar | Fungi |
| | Glucose-Yeast extract agar + tetracyclin | Selective enumeration of yeasts and moulds. |
| | Potato-Dextrose agar | Yeasts and molds |
| | Sabouraud Agar | Yeasts, molds and aciduric microorganisms |
| | V8 Agar | |
| | Malt Dextrose Agar | Identification of yeasts and moulds |
| | Czapek's medium | Fungi and Mold |
| | SPT agar | *Verticillium* sp. |

TABLE 7

Antibiotics

| Generic name | Brand names | Common uses | Mechanism of action |
|---|---|---|---|
| Aminoglycosides | | | |
| Amikacin | Amikin | Infections caused by Gram-negative bacteria, such as *Escherichia coli* and *Klebsiella* particularly *Pseudomonas aeruginosa.* Effective against Aerobic bacteria (not obligate/facultative anaerobes) and tularemia. | Binding to the bacterial 30S ribosomal subunit (some work by binding to the 50S subunit), inhibiting the translocation of the peptidyl-tRNA from the A-site to the P-site and also causing misreading of mRNA, leaving the bacterium unable to synthesize proteins vital to its growth. |
| Gentamicin | Garamycin | | |
| Kanamycin | Kantrex | | |
| Neomycin | Neo-Fradin[3] | | |
| Netilmicin | Netromycin | | |
| Tobramycin | Nebcin | | |
| Paromomycin | Humatin | | |
| Spectinomycin | Trobicin | Gonorrhea | |
| Ansamycins | | | |
| Geldanamycin | | Experimental, as antitumor antibiotics | |
| Herbimycin | | | |
| Rifaximin, streptomycin | Xifaxan | Travelers diarrhea caused by *E. coli* | |
| Carbacephem | | | |
| Loracarbef | Lorabid | Discontinued | prevents bacterial cell division by inhibiting cell wall synthesis. |
| Carbapenems | | | |
| Ertapenem | Invanz | Bactericidal for both Gram-positive and Gram-negative organisms and therefore useful for empiric broad-spectrum antibacterial coverage. (Note MRSA resistance to this class.) | Inhibition of cell wall synthesis |
| Doripenem | Doribax | | |
| Imipenem/Cilastatin | Primaxin | | |
| Meropenem | Merrem | | |

TABLE 7-continued

Antibiotics

| Generic name | Brand names | Common uses | Mechanism of action |
| --- | --- | --- | --- |
| Cephalosporins (First generation) | | | |
| Cefadroxil<br>Cefazolin<br>Cefalotin or Cefalothin<br>Cefalexin | Duricef<br>Ancef<br>Keflin<br><br>Keflex | Good coverage against Gram-positive infections. | Same mode of action as other beta-lactam antibiotics: disrupt the synthesis of the peptidoglycan layer of bacterial cell walls. |
| Cephalosporins (Second generation) | | | |
| Cefaclor<br>Cefamandole<br>Cefoxitin<br>Cefprozil<br>Cefuroxime | Distaclor<br>Mandol<br>Mefoxin<br>Cefzil<br>Ceftin, Zinnat (UK) | Less Gram-positive cover, improved Gram-negative cover. | Same mode of action as other beta-lactam antibiotics: disrupt the synthesis of the peptidoglycan layer of bacterial cell walls. |
| Cephalosporins (Third generation) | | | |
| Cefixime<br>Cefdinir<br>Cefditoren<br>Cefoperazone<br>Cefotaxime<br>Cefpodoxime<br>Ceftazidime<br>Ceftibuten<br>Ceftizoxime<br>Ceftriaxone | Suprax<br>Omnicef, Cefdiel<br>Spectracef<br>Cefobid<br>Claforan<br>Vantin<br>Fortaz<br>Cedax<br>Cefizox<br>Rocephin | Improved coverage of Gram-negative organisms, except *Pseudomonas*. Reduced Gram-positive cover. | Same mode of action as other beta-lactam antibiotics: disrupt the synthesis of the peptidoglycan layer of bacterial cell walls. |
| Cephalosporins (Fourth generation) | | | |
| Cefepime | Maxipime | Covers pseudomonal infections. | Same mode of action as other beta-lactam antibiotics: disrupt the synthesis of the peptidoglycan layer of bacterial cell walls. |
| Cephalosporins (Fifth generation) | | | |
| Ceftaroline fosamil | Teflaro | Used to treat MRSA | Same mode of action as other beta-lactam antibiotics: disrupt the synthesis of the peptidoglycan layer of bacterial cell walls. |
| Ceftobiprole | Zeftera | Used to treat MRSA | Same mode of action as other beta-lactam antibiotics: disrupt the synthesis of the peptidoglycan layer of bacterial cell walls. |
| Glycopeptides | | | |
| Teicoplanin<br>Vancomycin<br>Telavancin | Targocid (UK)<br>Vancocin<br>Vibativ | Active against aerobic and anaerobic Gram-positive bacteria including MRSA; Vancomycin is used orally for the treatment of *C. difficile* | inhibiting peptidoglycan synthesis |
| Lincosamides | | | |
| Clindamycin<br>Lincomycin | Cleocin<br>Lincocin | Serious staph-, pneumo-, and streptococcal infections in penicillin-allergic patients, also anaerobic infections; clindamycin topically for acne | Bind to 50S subunit of bacterial ribosomal RNA thereby inhibiting protein synthesis |
| Lipopeptide | | | |
| Daptomycin | Cubicin | Gram-positive organisms | Bind to the membrane and cause rapid depolarization, resulting in a loss of membrane potential leading to inhibition of protein, DNA and RNA synthesis |

TABLE 7-continued

Antibiotics

| Generic name | Brand names | Common uses | Mechanism of action |
|---|---|---|---|
| Macrolides | | | |
| Azithromycin | Zithromax, Sumamed, Xithrone | Streptococcal infections, syphilis, upper respiratory tract infections, lower respiratory tract infections, mycoplasmal infections, Lyme disease | inhibition of bacterial protein biosynthesis by binding reversibly to the subunit 50S of the bacterial ribosome, thereby inhibiting translocation of peptidyl tRNA. |
| Clarithromycin | Biaxin | | |
| Dirithromycin | Dynabac | | |
| Erythromycin | Erythocin, Erythroped | | |
| Roxithromycin | | | |
| Troleandomycin | Tao | | |
| Telithromycin | Ketek | Pneumonia | |
| Spiramycin | Rovamycine | Mouth infections | |
| Monobactams | | | |
| Aztreonam | Azactam | | Same mode of action as other beta-lactam antibiotics: disrupt the synthesis of the peptidoglycan layer of bacterial cell walls. |
| Nitrofurans | | | |
| Furazolidone | Furoxone | Bacterial or protozoal diarrhea or enteritis | |
| Nitrofurantoin | Macrodantin, Macrobid | Urinary tract infections | |
| Oxazolidonones | | | |
| Linezolid | Zyvox | VRSA | Protein synthesis inhibitor; prevents the initiation step |
| Posizolid | Phase II clinical trials | | |
| Radezolid | Phase II clinical trials | | |
| Torezolid | Phase II clinical trials | | |
| Penicillins | | | |
| Amoxicillin | Novamox, Amoxil | Wide range of infections; penicillin used for streptococcal infections, syphilis, and Lyme disease | Same mode of action as other beta-lactam antibiotics: disrupt the synthesis of the peptidoglycan layer of bacterial cell walls. |
| Ampicillin | Principen | | |
| Azlocillin | | | |
| Carbenicillin | Geocillin | | |
| Cloxacillin | Tegopen | | |
| Dicloxacillin | Dynapen | | |
| Flucloxacillin | Floxapen (Sold to European generics Actavis Group) | | |
| Mezlocillin | Mezlin | | |
| Methicillin | Staphcillin | | |
| Nafcillin | Unipen | | |
| Oxacillin | Prostaphlin | | |
| Penicillin G | Pentids | | |
| Penicillin V | Veetids (Pen-Vee-K) | | |
| Piperacillin | Pipracil | | |
| Penicillin G | Pfizerpen | | |
| Temocillin | Negaban (UK) | | |
| Ticarcillin | Ticar | | |
| Penicillin combinations | | | |
| Amoxicillin/ clavulanate | Augmentin | | The second component prevents bacterial resistance to the first component |
| Ampicillin/ sulbactam | Unasyn | | |
| Piperacillin/ tazobactam | Zosyn | | |
| Ticarcillin/ clavulanate | Timentin | | |
| Polypeptides | | | |
| Bacitracin | | Eye, ear or bladder infections; usually applied directly to the eye or inhaled into the lungs; rarely given by | Inhibits isoprenyl pyrophosphate, a molecule that carries the building blocks of the peptidoglycan bacterial cell wall outside of the inner membrane[5] |

TABLE 7-continued

Antibiotics

| Generic name | Brand names | Common uses | Mechanism of action |
| --- | --- | --- | --- |
| Colistin Polymyxin B | Coly-Mycin-S | injection, although the use of intravenous colistin is experiencing a resurgence due to the emergence of multi drug resistant organisms. | Interact with the Gram-negative bacterial outer membrane and cytoplasmic membrane. It displaces bacterial counter ions, which destabilizes the outer membrane. They act like a detergent against the cytoplasmic membrane, which alters its permeability. Polymyxin B and E are bactericidal even in an isosmotic solution. |
| Quinolones | | | |
| Ciprofloxacin | Cipro, Ciproxin, Ciprobay | Urinary tract infections, bacterial prostatitis, community-acquired pneumonia, bacterial diarrhea, mycoplasmal infections, gonorrhea | inhibit the bacterial DNA gyrase or the topoisomerase IV enzyme, thereby inhibiting DNA replication and transcription. |
| Enoxacin | Penetrex | | |
| Gatifloxacin | Tequin | | |
| Levofloxacin | Levaquin | | |
| Lomefloxacin | Maxaquin | | |
| Moxifloxacin | Avelox | | |
| Nalidixic acid | NegGram | | |
| Norfloxacin | Noroxin | | |
| Ofloxacin | Floxin, Ocuflox | | |
| Trovafloxacin | Trovan | Withdrawn | |
| Grepafloxacin | Raxar | Withdrawn | |
| Sparfloxacin | Zagam | Withdrawn | |
| Temafloxacin | Omniflox | Withdrawn | |
| Sulfonamides | | | |
| Mafenide | Sulfamylon | Urinary tract infections (except sulfacetamide, used for eye infections, and mafenide and silver sulfadiazine, used topically for burns) | Folate synthesis inhibition. They are competitive inhibitors of the enzyme dihydropteroate synthetase, DHPS. DHPS catalyses the conversion of PABA (para-aminobenzoate) to dihydropteroate, a key step in folate synthesis. Folate is necessary for the cell to synthesize nucleic acids (nucleic acids are essential building blocks of DNA and RNA), and in its absence cells cannot divide. |
| Sulfacetamide | Sulamyd, Bleph-10 | | |
| Sulfadiazine | Micro-Sulfon | | |
| Silver sulfadiazine | Silvadene | | |
| Sulfadimethoxine | Di-Methox, Albon | | |
| Sulfamethizole | Thiosulfil Forte | | |
| Sulfamethoxazole | Gantanol | | |
| Sulfanilimide (archaic) | | | |
| Sulfasalazine | Azulfidine | | |
| Sulfisoxazole | Gantrisin | | |
| Trimethoprim-Sulfamethoxazole (Co-trimoxazole) (TMP-SMX) | Bactrim, Septra | | |
| Sulfonamidoc hrysoidine (archaic) | Prontosil | | |
| Tetracyclines | | | |
| Demeclocycline | Declomycin | Syphilis, chlamydial infections, Lyme disease, mycoplasmal infections, acne rickettsial infections, *malaria *Note: Malaria is caused by a protist and not a bacterium. | inhibiting the binding of aminoacyl-tRNA to the mRNA-ribosome complex. They do so mainly by binding to the 30S ribosomal subunit in the mRNA translation complex. |
| Doxycycline | Vibramycin | | |
| Minocycline | Minocin | | |
| Oxytetracycline | Terramycin | | |
| Tetracycline | Sumycin, Achromycin V, Steclin | | |
| Drugs against mycobacteria | | | |
| Clofazimine | Lamprene | Antileprotic | |
| Dapsone | Avlosulfon | Antileprotic | |
| Capreomycin | Capastat | Antituberculosis | |
| Cycloserine | Seromycin | Antituberculosis, urinary tract infections | |
| Ethambutol | Myambutol | Antituberculosis | |
| Ethionamide | Trecator | Antituberculosis | Inhibits peptide synthesis |
| Isoniazid | I.N.H. | Antituberculosis | |
| Pyrazinamide | Aldinamide | Antituberculosis | |
| Rifampicin (Rifampin in US) | Rifadin, Rimactane | mostly Gram-positive and mycobacteria | Binds to the β subunit of RNA polymerase to inhibit transcription |
| Rifabutin | Mycobutin | *Mycobacterium avium* complex | |
| Rifapentine | Priftin | Antituberculosis | |
| Streptomycin | | Antituberculosis | As other aminoglycosides |

TABLE 7-continued

| Antibiotics | | | |
|---|---|---|---|
| Generic name | Brand names | Common uses | Mechanism of action |
| Others | | | |
| Arsphenamine | Salvarsan | Spirochaetal infections (obsolete) | |
| Chloramphenicol | Chloromycetin | meningitis, MRSA, topical use, or for low cost internal treatment. Historic: typhus, cholera. Gram-negative, Gram-positive, anaerobes | Inhibits bacterial protein synthesis by binding to the 50S subunit of the ribosome |
| Fosfomycin | Monurol | Acute cystitis in women | Inactivates enolpyruvyl transferase, thereby blocking cell wall synthesis |
| Fusidic acid | Fucidin | | |
| Metronidazole | Flagyl | Infections caused by anaerobic bacteria; also amoebiasis, trichomoniasis, Giardiasis | Produces toxic free radicals that disrupt DNA and proteins. This non-specific mechanism is responsible for its activity against a variety of bacteria, amoebae, and protozoa. |
| Mupirocin | Bactroban | Ointment for impetigo, cream for infected cuts | Inhibits isoleucine t-RNA synthetase (IleRS) causing inhibition of protein synthesis |
| Platensimycin | | | |
| Quinupristin/ Dalfopristin | Synercid | | |
| Thiamphenicol | | Gram-negative, Gram-positive, anaerobes, widely used in veterinary medicine. | A chloramphenicol analog. May inhibit bacterial protein synthesis by binding to the 50S subunit of the ribosome |
| Tigecycline | Tigacyl | Indicated for complicated skin/skin structure infections and complicated intra-abdominal infections. ‖ Teeth discoloration. ‖ | |
| Tinidazole | Tindamax Fasigyn | protozoan infections | |
| Trimethoprim | Proloprim, Trimpex | Urinary Tract Infections | |

TABLE 8

| TRANSGENIC PLANTS | | | | |
|---|---|---|---|---|
| Crop | Event | Company | Description | Patent |
| Potato | ATBT04-6, ATBT04-27, ATBT04-30, ATBT04-31, ATBT04-36, SPBT02-5, SPBT02-7 | Monsanto Company | Colorado potato beetle resistant potatoes produced by inserting the cry3A gene from *Bacillus thuringiensis* (subsp. *Tenebrionis*). | |
| Potato | BT6, BT10, BT12, BT16, BT17, BT18, BT23 | Monsanto Company | Colorado potato beetle resistant potatoes produced by inserting the cry3A gene from *Bacillus thuringiensis* (subsp. *Tenebrionis*). | |
| Potato | EH92-527-1 | BASF Plant Science | Altered starch composition, increased amylopectin to amylose ratio, through the introduction of a fragment of the potato granule-bound starch synthase encoding gene (gbss) in the anti-sense orientation. The nptIIgene was also introduced as a selectable marker for identifying transformed plants. | |
| Potato | RBMT15-101, SEMT15-02, SEMT15-15 | Monsanto Company | Colorado potato beetle and potato virus Y (PVY) resistant potatoes produced by inserting the cry3A gene from *Bacillus thuringiensis* (subsp. *Tenebrionis*) and the coat protein encoding gene from PVY. | |

TABLE 8-continued

TRANSGENIC PLANTS

| Crop | Event | Company | Description | Patent |
|---|---|---|---|---|
| Potato | RBMT21-129, RBMT21-350, RBMT22-082 | Monsanto Company | Colorado potato beetle and potato leafroll virus (PLRV) resistant potatoes produced by inserting the cry3A gene from *Bacillus thuringiensis* (subsp. *Tenebrionis*) and the replicase encoding gene from PLRV. | |
| Rice | CL121, CL141, CFX51 | BASF Inc. | Tolerance to the imidazolinone herbicide, imazethapyr, induced by chemical mutagenesis of the acetolactate synthase (ALS) enzyme using ethyl methanesulfonate (EMS). | |
| Rice | IMINTA-1, IMINTA-4 | BASF Inc. | Tolerance to imidazolinone herbicides induced by chemical mutagenesis of the acetolactate synthase (ALS) enzyme using sodium azide. | US 20070028318 A1 |
| Rice | LLRICE06, LLRICE62 | Aventis CropScience | Glufosinate ammonium herbicide tolerant rice produced by inserting a modified phosphinothricin acetyltransferase (PAT) encoding gene from the soil bacterium *Streptomyces hygroscopicus*). | WO 2001083818 A2 |
| Rice | LLRICE601 | Bayer CropScience (Aventis CropScience (AgrEvo)) | Glufosinate ammonium herbicide tolerant rice produced by inserting a modified phosphinothricin acetyltransferase (PAT) encoding gene from the soil bacterium*Streptomyces hygroscopicus*). | US 20080289060 A1 |
| Rice | PWC16 | BASF Inc. | Tolerance to the imidazolinone herbicide, imazethapyr, induced by chemical mutagenesis of the acetolactate synthase (ALS) enzyme using ethyl methanesulfonate (EMS). | |
| Soybean | A2704-12, A2704-21, A5547-35 | Bayer CropScience (Aventis CropScience (AgrEvo)) | Glufosinate ammonium herbicide tolerant soybean produced by inserting a modified phosphinothricin acetyltransferase (PAT) encoding gene from the soil bacterium*Streptomyces viridochromogenes*. | |
| Soybean | A5547-127 | Bayer CropScience (Aventis CropScience (AgrEvo) | Glufosinate ammonium herbicide tolerant soybean produced by inserting a modified phosphinothricin acetyltransferase (PAT) encoding gene from the soil bacterium*Streptomyces viridochromogenes*. | |
| Soybean | BPS-CV127-9 | BASF Inc. | The introduced csr1-2 gene from *Arabidopsis thaliana* encodes an acetohydroxyacid synthase protein that confers tolerance to imidazolinone herbicides due to a point mutation that results in a single amino acid substitution in which the serine residue at position 653 is replaced by asparagine (S653N). | |
| Soybean | DP-305423 | DuPont Pioneer | High oleic acid soybean produced by inserting additional copies of a portion of the omega-6 desaturase encoding gene, gm-fad2-1 resulting in silencing of the endogenous omega-6 desaturase gene (FAD2-1). | |
| Soybean | DP356043 | DuPont Pioneer | Soybean event with two herbicide tolerance genes: glyphosate N-acetlytransferase, which detoxifies glyphosate, and a modified acetolactate synthase (ALS) gene which is tolerant to ALS-inhibitng herbicides. | |
| Soybean | G94-1, G94-19, G168 | DuPont Canada Agricultural Products | High oleic acid soybean produced by inserting a second copy of the fatty acid desaturase (GmFad2-1) encoding gene from soybean, which resulted in "silencing" of the endogenous host gene. | |

TABLE 8-continued

TRANSGENIC PLANTS

| Crop | Event | Company | Description | Patent |
|---|---|---|---|---|
| Soybean | GTS 40-3-2 | Monsanto Company | Glyphosate tolerant soybean variety produced by inserting a modified 5-enolpyruvylshikimate-3-phosphate synthase (EPSPS) encoding gene from the soil bacterium *Agrobacterium tumefaciens*. | |
| Soybean | GU262 | Bayer CropScience (Aventis CropScience (AgrEvo)) | Glufosinate ammonium herbicide tolerant soybean produced by inserting a modified phosphinothricin acetyltransferase (PAT) encoding gene from the soil bacterium *Streptomyces viridochromogenes*. | |
| Soybean | MON87701 | Monsanto Company | Resistance to lepidopteran pests of soybean including velvetbean caterpillar (*Anticarsia gemmatalis*) and soybean looper (*Pseudoplusia includens*). | |
| Soybean | MON87701 × MON89788 | Monsanto Company | Glyphosate herbicide tolerance through expression of the EPSPS encoding gene from *A. tumefaciens* strain CP4, and resistance to lepidopteran pests of soybean including velvetbean caterpillar (*Anticarsia gemmatalis*) and soybean looper (*Pseudoplusia includens*) via expression of the Cry1Ac encoding gene from *B. thuringiensis*. | U.S. Pat. No. 8,455,198 B2 |
| Soybean | MON89788 | Monsanto Company | Glyphosate-tolerant soybean produced by inserting a modified 5-enolpyruvylshikimate-3-phosphate synthase (EPSPS) encoding aroA (epsps) gene from *Agrobacterium tumefaciens* CP4. | |
| Soybean | OT96-15 | Agriculture & Agri-Food Canada | Low linolenic acid soybean produced through traditional cross-breeding to incorporate the novel trait from a naturally occurring fan1 gene mutant that was selected for low linolenic acid. | U.S. Pat. No. 7,632,985 B2 |
| Soybean | W62, W98 | Bayer CropScience (Aventis CropScience (AgrEvo)) | Glufosinate ammonium herbicide tolerant soybean produced by inserting a modified phosphinothricin acetyltransferase (PAT) encoding gene from the soil bacterium *Streptomyces hygroscopicus*. | |
| Squash | CZW-3 | Asgrow (USA); Seminis Vegetable Inc. (Canada) | Cucumber mosiac virus (CMV), zucchini yellows mosaic (ZYMV) and watermelon mosaic virus (WMV) 2 resistant squash (*Curcurbita pepo*) produced by inserting the coat protein (CP) encoding sequences from each of these plant viruses into the host genome. | U.S. Pat. No. 6,337,431 B1 |
| Squash | ZW20 | Upjohn (USA); Seminis Vegetable Inc. (Canada) | Zucchini yellows mosaic (ZYMV) and watermelon mosaic virus (WMV) 2 resistant squash (*Curcurbita pepo*) produced by inserting the coat protein (CP) encoding sequences from each of these plant potyviruses into the host genome. | U.S. Pat. No. 6,337,431 B1 |
| Beet | GTSB77 | Novartis Seeds; Monsanto Company | Glyphosate herbicide tolerant sugar beet produced by inserting a gene encoding the enzyme 5-enolypyruvylshikimate-3-phosphate synthase (EPSPS) from the CP4 strain of *Agrobacterium tumefaciens*. | |
| Beet | H7-1 | Monsanto Company | Glyphosate herbicide tolerant sugar beet produced by inserting a gene encoding the enzyme 5-enolypyruvylshikimate-3-phosphate synthase (EPSPS) from the CP4 strain of *Agrobacterium tumefaciens*. | U.S. Pat. No. 7,335,816 B2 |

TABLE 8-continued

TRANSGENIC PLANTS

| Crop | Event | Company | Description | Patent |
|---|---|---|---|---|
| Beet | T120-7 | Bayer CropScience (Aventis CropScience (AgrEvo)) | Introduction of the PPT-acetyltransferase (PAT) encoding gene from *Streptomyces viridochromogenes*, an aerobic soil bacteria. PPT normally acts to inhibit glutamine synthetase, causing a fatal accumulation of ammonia. Acetylated PPT is inactive. | |
| Tobacco | C/F/93/08-02 | Societe National dExploitation des Tabacs et Allumettes | Tolerance to the herbicides bromoxynil and ioxynil by incorporation of the nitrilase gene from *Klebsiella pneumoniae*. | |
| Tobacco | Vector 21-41 | Vector Tobacco Inc. | Reduced nicotine content through introduction of a second copy of the tobacco quinolinic acid phosphoribosyltransferase (QTPase) in the antisense orientation. The NPTII encoding gene from *E. coli* was introduced as a selectable marker to identify transformants. | US 20050072047 A1 |
| Wheat | AP205CL | BASF Inc. | Selection for a mutagenized version of the enzyme acetohydroxyacid synthase (AHAS), also known as acetolactate synthase (ALS) or acetolactate pyruvate- lyase. | |
| Wheat | AP602CL | BASF Inc. | Selection for a mutagenized version of the enzyme acetohydroxyacid synthase (AHAS), also known as acetolactate synthase (ALS) or acetolactate pyruvate- lyase. | |
| Wheat | BW255-2, BW238-3 | BASF Inc. | Selection for a mutagenized version of the enzyme acetohydroxyacid synthase (AHAS), also known as acetolactate synthase (ALS) or acetolactate pyruvate- lyase. | |
| Wheat | BW7 | BASF Inc. | Tolerance to imidazolinone herbicides induced by chemical mutagenesis of the acetohydroxyacid synthase (AHAS) gene using sodium azide. | |
| Wheat | MON71800 | Monsanto Company | Glyphosate tolerant wheat variety produced by inserting a modified 5-enolpyruvylshikimate-3-phosphate synthase (EPSPS) encoding gene from the soil bacterium *Agrobacterium tumefaciens*, strain CP4. | U.S. Pat. No. 6,689,880 |
| Wheat | SWP965001 | Cyanamid Crop Protection | Selection for a mutagenized version of the enzyme acetohydroxyacid synthase (AHAS), also known as acetolactate synthase (ALS) or acetolactate pyruvate- lyase. | |
| Wheat | Teal 11A | BASF Inc. | Selection for a mutagenized version of the enzyme acetohydroxyacid synthase (AHAS), also known as acetolactate synthase (ALS) or acetolactate pyruvate- lyase. | |

TABLE 9

FUNGICIDES COMMONLY USED IN AGRICULTURE 2-(thiocyanatomethylthio)-benzothiazole, 2-phenylphenol, 8-hydroxyquinoline sulfate, ametoctradin, amisulbrom, antimycin, Ampelomyces quisqualis, azaconazole, azoxystrobin, *Bacillus subtilis*, benalaxyl, benomyl, benthiavalicarb-isopropyl, benzylaminobenzene-sulfonate (BABS) salt, bicarbonates, biphenyl, bismerthiazol, bitertanol, bixafen, blasticidin-S, borax, Bordeaux mixture, boscalid, bromuconazole, bupirimate, calcium polysulfide, captafol, captan, carbendazim, carboxin, carpropamid, carvone, chloroneb, chlorothalonil, chlozolinate, *Coniothyrium minitans*, copper hydroxide, copper octanoate, copper oxychloride, copper sulfate, copper sulfate (tribasic), cuprous oxide, cyazofamid, cyflufenamid, cymoxanil, cyproconazole, cyprodinil, dazomet, debacarb, diammonium ethylenebis-(dithiocarbamate), dichlofluanid, dichlorophen, diclocymet, diclomezine, dichloran, diethofencarb, difenoconazole, difenzoquat ion, diflumetorim, dimethomorph, dimoxystrobin, diniconazole, diniconazole-M, dinobuton, dinocap, diphenylamine, dithianon, TABLE 9-continued

FUNGICIDES COMMONLY USED IN AGRICULTURE dodemorph, dodemorph acetate, dodine, dodine free base, edifenphos, enestrobin, epoxiconazole, ethaboxam, ethoxyquin, etridiazole, famoxadone, fenamidone, fenarimol, fenbuconazole, fenfuram, fenhexamid, fenoxanil, fenpiclonil, fenpropidin, fenpropimorph, fentin, fentin acetate, fentin hydroxide, ferbam, ferimzone, fluazinam, fludioxonil, flumorph, fluopicolide, fluopyram, fluoroimide, fluoxastrobin, fluquinconazole, flusilazole, flusulfamide, flutianil, flutolanil, flutriafol, fluxapyroxad, folpet, formaldehyde, fosetyl, fosetyl-aluminium, fuberidazole, furalaxyl, furametpyr, guazatine, guazatine acetates, GY-81, hexachlorobenzene, hexaconazole, hymexazol, imazalil, imazalil sulfate, imibenconazole, iminoctadine, iminoctadine triacetate, iminoctadine tris(albesilate), ipconazole, iprobenfos, iprodione, iprovalicarb, isoprothiolane, isopyrazam, isotianil, kasugamycin, kasugamycin hydrochloride hydrate, kresoxim-methyl, mancopper, mancozeb, mandipropamid, maneb, mepanipyrim, mepronil, mercuric chloride, mercuric oxide, mercurous chloride, metalaxyl, mefenoxam, metalaxyl-M, metam, metam-ammonium, metam-potassium, metam-sodium, metconazole, methasulfocarb, methyl iodide, methyl isothiocyanate, metiram, metominostrobin, metrafenone, mildiomycin, myclobutanil, nabam, nitrothal-isopropyl, nuarimol, octhilinone, ofurace, oleic acid (fatty acids), orysastrobin, oxadixyl, oxine-copper, oxpoconazole fumarate, oxycarboxin, pefurazoate, penconazole, pencycuron, penflufen, pentachlorophenol, pentachlorophenyl laurate, penthiopyrad, phenylmercury acetate, phosphonic acid, phthalide, picoxystrobin, polyoxin B, polyoxins, polyoxorim, potassium bicarbonate, potassium hydroxyquinoline sulfate, probenazole, prochloraz, procymidone, propamocarb, propamocarb hydrochloride, propiconazole, propineb, proquinazid, prothioconazole, pyraclostrobin, pyrametostrobin, pyraoxystrobin, pyrazophos, pyribencarb, pyributicarb, pyrifenox, pyrimethanil, pyroquilon, quinoclamine, quinoxyfen, quintozene, *Reynoutria sachalinensis* extract, sedaxane, silthiofam, simeconazole, sodium 2-phenylphenoxide, sodium bicarbonate, sodium pentachlorophenoxide, spiroxamine, sulfur, SYP-Z071, SYP-Z048, tar oils, tebuconazole, tebufloquin, tecnazene, tetraconazole, thiabendazole, thifluzamide, thiophanate-methyl, thiram, tiadinil, tolclofos-methyl, tolylfluanid, triadimefon, triadimenol, triazoxide, tricyclazole, tridemorph, trifloxystrobin, triflumizole, triforine, triticonazole, validamycin, valifenalate, valiphenal, vinclozolin, zineb, ziram, zoxamide, *Candida oleophila, Fusarium oxysporum, Gliocladium* spp., *Phlebiopsis gigantea, Streptomyces griseoviridis, Trichoderma* spp., (RS)-N-(3,5-dichlorophenyl)-2-(methoxymethyl)-succinimide, 1,2-dichloropropane, 1,3-dichloro-1,1,3,3-tetrafluoroacetone hydrate, 1-chloro-2,4-dinitronaphthalene, 1-chloro-2-nitropropane, 2-(2-heptadecyl-2-imidazolin-1-yl)ethanol, 2,3-dihydro-5-phenyl-1,4-dithi-ine 1,1,4,4-tetraoxide, 2-methoxyethylmercury acetate, 2-methoxyethylmercury chloride, 2-methoxyethylmercury silicate, 3-(4-chlorophenyl)-5-methylrhodanine, 4-(2-nitroprop-1-enyl)phenyl thiocyanateme, ampropylfos, anilazine, azithiram, barium polysulfide, Bayer 32394, benodanil, benquinox, bentaluron, benzamacril; benzamacril-isobutyl, benzamorf, binapacryl, bis(methylmercury) sulfate, bis(tributyltin) oxide, buthiobate, cadmium calcium copper zinc chromate sulfate, carbamorph, CECA, chlobenthiazone, chloraniformethan, chlorfenazole, chlorquinox, climbazole, cyclafuramid, cypendazole, cyprofuram, decafentin, dichlone, dichlozoline, diclobutrazol, dimethirimol, dinocton, dinosulfon, dinoterbon, dipyrithione, ditalimfos, dodicin, drazoxolon, EBP, ESBP, etaconazole, etem, ethirim, fenaminosulf, fenapanil, fenitropan, 5-fluorocytosine and profungicides thereof, fluotrimazole, furcarbanil, furconazole, furconazole-cis, furmecyclox, furophanate, glyodine, griseofulvin, halacrinate, Hercules 3944, hexylthiofos, ICIA0858, isopamphos, isovaledione, mebenil, mecarbinzid, metazoxolon, methfuroxam, methylmercury dicyandiamide, metsulfovax, milneb, mucochloric anhydride, myclozolin, N-3,5-dichlorophenyl-succinimide, N-3-nitrophenylitaconimide, natamycin, N-ethylmercurio-4-toluenesulfonanilide, nickel bis(dimethyldithiocarbamate), OCH, phenylmercury dimethyldithiocarbamate, phenylmercury nitrate, phosdiphen, picolinamide UK-2A and derivatives thereof, prothiocarb; prothiocarb hydrochloride, pyracarbolid, pyridinitril, pyroxychlor, pyroxyfur, quinacetol; quinacetol sulfate, quinazamid, quinconazole, rabenzazole, salicylanilide, SSF-109, sultropen, tecoram, thiadifluor, thicyofen, thiochlorfenphim, thiophanate, thioquinox, tioxymid, triamiphos, triarimol, triazbutil, trichlamide, urbacid, XRD-563, and zarilamide, IK-1140.

TABLE 10

POPULAR FUNGICIDES

| Crop | Popular Fungicides Used |
|---|---|
| Corn | Syngenta Maxim Quattro (mefenoxam, fludioxonil, azoxystrobin & thiabendazole; systemic action, "cleans up surface and internal pathogens"; targeted at *Fusarium*, broad spectrum); Monsanto Acceleron: DC-309 (metalaxyl), DC-509 (ipconazole), DX-709 (trifloxystrobin); BASF: Stamina (pyraclostrobin), Stamina F3 (pyraclostrobin, triticonazole, metalaxyl) |
| Soybean | Monsanto Acceleron: DX-109 (pyraclostrobin), DX-309 (metalaxyl), Bayer EverGol Energy (prothioconazole, metalaxyl & penflufen); |
| Wheat | BASF: Charter F2 (triticonazole, metalaxyl), Stamina (pyraclostrobin), Stamina F3 (pyraclostrobin, triticonazole, metalaxyl), Charter (triticonazole); Syngenta Dividend (difenoconazole); |

TABLE 11

COMMON HERBICIDES

4- CPA; 4-CPB; 4-CPP; 2,4-D; 3,4-DA; 2,4-DB; 3,4-DB; 2,4-DEB; 2,4-DEP; 3,4-DP; 2,3,6-TBA; 2,4,5-T; 2,4,5-TB; acetochlor, acifluorfen, aclonifen, acrolein, alachlor, allidochlor, alloxydim, allyl alcohol, alorac, ametridione, ametryn, amibuzin, amicarbazone, amidosulfuron, aminocyclopyrachlor, aminopyralid, amiprofos-methyl, amitrole, ammonium sulfamate, anilofos, anisuron, asulam, atraton, atrazine, azafenidin, azimsulfuron, aziprotryne, barban, BCPC, beflubutamid, benazolin, bencarbazone, benfluralin, benfuresate, bensulfuron, bensulide, bentazone, benzadox, benzfendizone, benzipram, benzobicyclon, benzofenap, benzofluor, benzoylprop, benzthiazuron, bicyclopyrone, bifenox, bilanafos, bispyribac, borax, bromacil, bromobonil, bromobutide, bromofenoxim, bromoxynil, brompyrazon, butachlor, butafenacil, butamifos, butenachlor, buthidazole, buthiuron, butralin, butroxydim, buturon, butylate, cacodylic acid, cafenstrole, calcium chlorate, calcium cyanamide, cambendichlor, carbasulam, carbetamide, carboxazole chlorprocarb, carfentrazone, CDEA, CEPC, chlomethoxyfen, chloramben, chloranocryl, chlorazifop, chlorazine, chlorbromuron, chlorbufam, chloreturon, chlorfenac, chlorfenprop, chlorflurazole, chlorflurenol, chloridazon, chlorimuron, chlornitrofen, chloropon, chlorotoluron, chloroxuron, chloroxynil, chlorpropham, chlorsulfuron, chlorthal, chlorthiamid, cinidon-ethyl, cinmethylin, cinosulfuron, cisanilide, clethodim, cliodinate, clodinafop, clofop, clomazone, clomeprop, cloprop, cloproxydim, clopyralid, cloransulam, CMA, copper sulfate, CPMF, CPPC, credazine, cresol, cumyluron, cyanatryn, cyanazine, cycloate, cyclosulfamuron, cycloxydim, cycluron, cyhalofop, cyperquat, cyprazine, cyprazole, cypromid, daimuron, dalapon, dazomet, delachlor, desmedipham, desmetryn, di-allate, dichlobenil, dichloralurea, dichlormate, dichlorprop, dichlorprop-P, diclofop, diclosulam, diethamquat, diethatyl, difenopenten, difenoxuron, difenzoquat, diflufenican, diflufenzopyr, dimefuron, dimepiperate, dimethachlor, dimethametryn, dimethenamid, dimethenamid-P, dimexano, dimidazon, dinitramine, dinofenate, dinoprop, dinosam, dinoseb, dinoterb, diphenamid, dipropetryn, diquat, disul, dithiopyr, diuron, DMPA, DNOC, DSMA, EBEP, eglinazine, endothal, epronaz, EPTC, erbon, esprocarb, ethalfluralin, ethametsulfuron, ethidimuron, ethiolate, ethofumesate, ethoxyfen, ethoxysulfuron, etinofen, etnipromid, etobenzanid, EXD, fenasulam, fenoprop, fenoxaprop, fenoxaprop-P, fenoxasulfone, fenteracol, fenthiaprop, fentrazamide, fenuron, ferrous sulfate, flamprop, flamprop-M, flazasulfuron, florasulam, fluazifop, fluazifop-P, fluazolate, flucarbazone, flucetosulfuron, fluchloralin, flufenacet, flufenican, flufenpyr, flumetsulam, flumezin, flumiclorac, flumioxazin, flumipropyn, fluometuron, fluorodifen, fluoroglycofen, fluoromidine, fluoronitrofen, fluothiuron, flupoxam, flupropacil, flupropanate, flupyrsulfuron, fluridone, flurochloridone, fluroxypyr, flurtamone, fluthiacet, fomesafen, foramsulfuron, fosamine, furyloxyfen, glufosinate, glufosinate-P, halosafen, halosulfuron, haloxydine, haloxyfop, haloxyfop-P, hexachloroacetone, hexaflurate, hexazinone, imazamethabenz, imazamox, imazapic, imazapyr, imazaquin, imazethapyr, imazosulfuron, indanofan, indaziflam, iodobonil, iodomethane, iodosulfuron, ioxynil, ipazine, ipfencarbazone, iprymidam, isocarbamid, isocil, isomethiozin, isonoruron, isopolinate, isopropalin, isoproturon, isouron, isoxaben, isoxachlortole, isoxaflutole, isoxapyrifop, karbutilate, ketospiradox, lactofen, lenacil, linuron, MAA, MAMA, MCPA, MCPA-thioethyl, MCPB, mecoprop, mecoprop-P, medinoterb, mefenacet, mefluidide, mesoprazine, mesosulfuron, mesotrione, metam, metamifop, metamitron, metazachlor, metazosulfuron, metflurazon, methabenzthiazuron, methalpropalin, methazole, methiobencarb, methiozolin, methiuron, methometon, methoprotryne, methyl bromide, methyl isothiocyanate, methyldymron, metobenzuron, metobromuron, metolachlor, metosulam, metoxuron, metribuzin, metsulfuron, molinate, monalide, monisouron, monochloroacetic acid, monolinuron, monuron, morfamquat, MSMA, naproanilide, napropamide, naptalam, neburon, nicosulfuron, nipyraclofen, nitralin, nitrofen, nitrofluorfen, norflurazon, noruron, OCH, orbencarb, ort/zo-dichlorobenzene, orthosulfamuron, oryzalin, oxadiargyl, oxadiazon, oxapyrazon, oxasulfuron, oxaziclomefone, oxyfluorfen, parafluron, paraquat, pebulate, pelargonic acid, pendimethalin, penoxsulam, pentachlorophenol, pentanochlor, pentoxazone, perfluidone, pethoxamid, phenisopham, phenmedipham, phenmedipham-ethyl, phenobenzuron, phenylmercury acetate, picloram, picolinafen, pinoxaden, piperophos, potassium arsenite, potassium azide, potassium cyanate, pretilachlor, primisulfuron, procyazine, prodiamine, profluazol, profluralin, profoxydim, proglinazine, prometon, prometryn, propachlor, propanil, propaquizafop, propazine, propham, propisochlor, propoxycarbazone, propyrisulfuron, propyzamide, prosulfalin, prosulfocarb, prosulfuron, proxan, prynachlor, pydanon, pyraclonil, pyraflufen, pyrasulfotole, pyrazolynate, pyrazosulfuron, pyrazoxyfen, pyribenzoxim, pyributicarb, pyriclor, pyridafol, pyridate, pyriftalid, pyriminobac, pyrimisulfan, pyrithiobac, pyroxasulfone, pyroxsulam, quinclorac, quinmerac, quinoclamine, quinonamid, quizalofop, quizalofop-P, rhodethanil, rimsulfuron, saflufenacil, S-metolachlor, sebuthylazine, secbumeton, sethoxydim, siduron, simazine, simeton, simetryn, SMA, sodium arsenite, sodium azide, sodium chlorate, sulcotrione, sulfallate, sulfentrazone, sulfometuron, sulfosulfuron, sulfuric acid, sulglycapin, swep, TCA, tebutam, tebuthiuron, tefuryltrione, tembotrione, tepraloxydim, terbacil, terbucarb, terbuchlor, terbumeton, terbuthylazine, terbutryn, tetrafluron, thenylchlor, thiazafluron, thiazopyr, thidiazimin, thidiazuron, thiencarbazone-methyl, thifensulfuron, thiobencarb, tiocarbazil, tioclorim, topramezone, tralkoxydim, tri-allate, triasulfuron, triaziflam, tribenuron, tricamba, triclopyr, tridiphane, trietazine, trifloxysulfuron, trifluralin, triflusulfuron, trifop, trifopsime, trihydroxytriazine, trimeturon, tripropindan, tritac tritosulfuron, vernolate and xylachlor.

TABLE 12

PLANT GROWTH REGULATORS

DB, 2,4-DEP, dichlorprop, fenoprop, IAA, IBA, naphthaleneacetamide, α-naphthaleneacetic acid, 1-naphthol, naphthoxyacetic acid, potassium naphthenate, sodium naphthenate, 2,4,5-T cytokinins such as 2iP, benzyladenine, kinetin, zeatin; defoliants such as calcium cyanamide, dimethipin, endothal, ethephon, merphos, metoxuron, pentachlorophenol, thidiazuron, tribufos; ethylene inhibitors such as aviglycine, 1-methylcyclopropene; ethylene releasers such as ACC, etacelasil, ethephon, glyoxime; gibberellins such as gibberellins, gibberellic acid; growth inhibitors such as abscisic acid, ancymidol, butralin, carbaryl, chlorphonium, chlorpropham, dikegulac, flumetralin, fluoridamid, fosamine, glyphosine, isopyrimol, jasmonic acid, maleic hydrazide, mepiquat, mepiquat, piproctanyl, prohydrojasmon, propham, 2,3,5-tri-iodobenzoic acid; morphactins such as chlorfluren, chlorflurenol, dichlorflurenol, flurenol; growth retardants such as chlormequat, daminozide, flurprimidol, mefluidide, paclobutrazol tetcyclacis, uniconazole; growth stimulators such as brassinolide, forchlorfenuron, hymexazol; and unclassified plant growth regulators such as benzofluor, buminafos, carvone, ciobutide, clofencet, cloxyfonac, cyanamide, cyclanilide, cycloheximide cyprosulfamide, epocholeone, ethychlozate, ethylene, fenridazon, heptopargil, holosulf, inabenfide, karetazan, lead arsenate, methasulfocarb, prohexadione, pydanon, sintofen, triapenthenol, and trinexapac.

TABLE 13

INSECTICIDES

Antibiotic insecticides such as allosamidin and thuringiensin; macrocyclic lactone insecticides such as spinosad, spinetoram, and other spinosyns including the 21-butenyl spinosyns and their derivatives; avermectin insecticides such as abamectin, doramectin, emamectin, eprinomectin, ivermectin and selamectin; milbemycin insecticides such as lepimectin, milbemectin, milbemycin oxime and moxidectin; arsenical insecticides such as calcium arsenate, copper acetoarsenite, copper arsenate, lead arsenate, potassium arsenite and sodium arsenite; biological insecticides such as *Bacillus popilliae, B. sphaericus, B. thuringiensis* subsp. *aizawai, B. thuringiensis* subsp. *kurstaki, B. thuringiensis* subsp. *tenebrionis, Beauveria bassiana, Cydia pomonella* granulosis virus, Douglas fir tussock moth NPV, gypsy moth NPV, *Helicoverpa zea* NPV, Indian meal moth granulosis virus, *Metarhizium anisopliae, Nosema locustae, Paecilomyces fumosoroseus, P. lilacinus, Photorhabdus luminescens, Spodoptera exigua* NPV, trypsin modulating oostatic factor, *Xenorhabdus nematophilus,* and *X. bovienii,* plant incorporated protectant insecticides such as Cry1Ab, Cry1Ac, Cry1F, Cry1A.105, Cry2Ab2, Cry3A, mir Cry3A, Cry3Bb1, Cry34, Cry35, and VIP3A; botanical insecticides such as anabasine, azadirachtin, d-limonene, nicotine, pyrethrins, cinerins, cinerin I, cinerin II, jasmolin I, jasmolin II, pyrethrin I, pyrethrin II, quassia, rotenone, ryania and sabadilla; carbamate insecticides such as bendiocarb and carbaryl; benzofuranyl methylcarbamate insecticides such as benfuracarb, carbofuran, carbosulfan, decarbofuran and furathiocarb; dimethylcarbamate insecticides dimitan, dimetilan, hyquincarb and pirimicarb; oxime carbamate insecticides such as alanycarb, aldicarb, aldoxycarb, butocarboxim, butoxycarboxim, methomyl, nitrilacarb, oxamyl, tazimcarb, thiocarboxime, thiodicarb and thiofanox; phenyl methylcarbamate insecticides such as allyxycarb, aminocarb, bufencarb, butacarb, carbanolate, cloethocarb, dicresyl, dioxacarb, EMPC, ethiofencarb, fenethacarb, fenobucarb, isoprocarb, methiocarb, metolcarb, mexacarbate, promacyl, promecarb, propoxur, trimethacarb, XMC and xylylcarb; dinitrophenol insecticides such as dinex, dinoprop, dinosam and DNOC; fluorine insecticides such as barium hexafluorosilicate, cryolite, sodium fluoride, sodium hexafluorosilicate and sulfluramid; formamidine insecticides such as amitraz, chlordimeform, formetanate and formparanate; fumigant insecticides such as acrylonitrile, carbon disulfide, carbon tetrachloride, chloroform, chloropicrin, para-dichlorobenzene, 1,2-dichloropropane, ethyl formate, ethylene dibromide, ethylene dichloride, ethylene oxide, hydrogen cyanide, iodomethane, methyl bromide, methylchloroform, methylene chloride, naphthalene, phosphine, sulfuryl fluoride and tetrachloroethane; inorganic insecticides such as borax, calcium polysulfide, copper oleate, mercurous chloride, potassium thiocyanate and sodium thiocyanate; chitin synthesis inhibitors such as bistrifluoron, buprofezin, chlorfluazuron, cyromazine, diflubenzuron, flucycloxuron, flufenoxuron, hexaflumuron, lufenuron, novaluron, noviflumuron, penfluoron, teflubenzuron and triflumuron; juvenile hormone mimics such as epofenonane, fenoxycarb, hydroprene, kinoprene, methoprene, pyriproxyfen and triprene; juvenile hormones such as juvenile hormone I, juvenile hormone II and juvenile hormone III; moulting hormone agonists such as chromafenozide, halofenozide, methoxyfenozide and tebufenozide; moulting hormones such as α-ecdysone and ecdysterone; moulting inhibitors such as diofenolan; precocenes such as precocene I, precocene II and precocene III; unclassified insect growth regulators such as dicyclanil; nereistoxin analogue insecticides such as bensultap, cartap, thiocyclam and thiosultap; nicotinoid insecticides such as flonicamid; nitroguanidine insecticides such as clothianidin, dinotefuran, imidacloprid and thiamethoxam; nitromethylene insecticides such as nitenpyram and nithiazine; pyridylmethylamine insecticides such as acetamiprid, imidacloprid, nitenpyram and thiacloprid; organochlorine insecticides such as bromo-DDT, camphechlor, DDT, pp'-DDT, ethyl-DDD, HCH, gamma-HCH, lindane, methoxychlor, pentachlorophenol and TDE; cyclodiene insecticides such as aldrin, bromocyclen, chlorbicyclen, chlordane, chlordecone, dieldrin, dilor, endosulfan, endrin, HEOD, heptachlor, HHDN, isobenzan, isodrin, kelevan and mirex; organophosphate insecticides such as bromfenvinfos, chlorfenvinphos, crotoxyphos, dichlorvos, dicrotophos, dimethylvinphos, fospirate, heptenophos,

TABLE 13-continued

INSECTICIDES methocrotophos, mevinphos, monocrotophos, naled, naftalofos, phosphamidon, propaphos, TEPP and tetrachlorvinphos; organothiophosphate insecticides such as dioxabenzofos, fosmethilan and phenthoate; aliphatic organothiophosphate insecticides such as acethion, amiton, cadusafos, chlorethoxyfos, chlormephos, demephion, demephion-O, demephion-S, demeton, demeton-O, demeton-S, demeton-methyl, demeton-O-methyl, demeton-S-methyl, demeton-S-methylsulphon, disulfoton, ethion, ethoprophos, IPSP, isothioate, malathion, methacrifos, oxydemeton-methyl, oxydeprofos, oxydisulfoton, phorate, sulfotep, terbufos and thiometon; aliphatic amide organothiophosphate insecticides such as amidithion, cyanthoate, dimethoate, ethoate-methyl, formothion, mecarbam, omethoate, prothoate, sophamide and vamidothion; oxime organothiophosphate insecticides such as chlorphoxim, phoxim and phoxim-methyl; heterocyclic organothiophosphate insecticides such as azamethiphos, coumaphos, coumithoate, dioxathion, endothion, menazon, morphothion, phosalone, pyraclofos, pyridaphenthion and quinothion; benzothiopyran organothiophosphate insecticides such as dithicrofos and thicrofos; benzotriazine organothiophosphate insecticides such as azinphos-ethyl and azinphos-methyl; isoindole organothiophosphate insecticides such as dialifos and phosmet; isoxazole organothiophosphate insecticides such as isoxathion and zolaprofos; pyrazolopyrimidine organothiophosphate insecticides such as chlorprazophos and pyrazophos; pyridine organothiophosphate insecticides such as chlorpyrifos and chlorpyrifos-methyl; pyrimidine organothiophosphate insecticides such as butathiofos, diazinon, etrimfos, lirimfos, pirimiphos-ethyl, pirimiphos-methyl, primidophos, pyrimitate and tebupirimfos; quinoxaline organothiophosphate insecticides such as quinalphos and quinalphos-methyl; thiadiazole organothiophosphate insecticides such as athidathion, lythidathion, methidathion and prothidathion; triazole organothiophosphate insecticides such as isazofos and triazophos; phenyl organothiophosphate insecticides such as azothoate, bromophos, bromophos-ethyl, carbophenothion, chlorthiophos, cyanophos, cythioate, dicapthon, dichlofenthion, etaphos, famphur, fenchlorphos, fenitrothion fensulfothion, fenthion, fenthion-ethyl, heterophos, jodfenphos, mesulfenfos, parathion, parathion-methyl, phenkapton, phosnichlor, profenofos, prothiofos, sulprofos, temephos, trichlormetaphos-3 and trifenofos; phosphonate insecticides such as butonate and trichlorfon; phosphonothioate insecticides such as mecarphon; phenyl ethylphosphonothioate insecticides such as fonofos and trichloronat; phenyl phenylphosphonothioate insecticides such as cyanofenphos, EPN and leptophos; phosphoramidate insecticides such as crufomate, fenamiphos, fosthietan, mephosfolan, phosfolan and pirimetaphos; phosphoramidothioate insecticides such as acephate, isocarbophos, isofenphos, methamidophos and propetamphos; phosphorodiamide insecticides such as dimefox, mazidox, mipafox and schradan; oxadiazine insecticides such as indoxacarb; phthalimide insecticides such as dialifos, phosmet and tetramethrin; pyrazole insecticides such as acetoprole, ethiprole, fipronil, pyrafluprole, pyriprole, tebufenpyrad, tolfenpyrad and vaniliprole; pyrethroid ester insecticides such as acrinathrin, allethrin, bioallethrin, barthrin, bifenthrin, bioethanomethrin, cyclethrin, cycloprothrin, cyfluthrin, beta-cyfluthrin, cyhalothrin, gamma-cyhalothrin, lambda-cyhalothrin, cypermethrin, alpha-cypermethrin, beta-cypermethrin, theta-cypermethrin, zeta-cypermethrin, cyphenothrin, deltamethrin, dimefluthrin, dimethrin, empenthrin, fenfluthrin, fenpirithrin, fenpropathrin, fenvalerate, esfenvalerate, flucythrinate, fluvalinate, tau-fluvalinate, furethrin, imiprothrin, metofluthrin, permethrin, biopermethrin, transpermethrin, phenothrin, prallethrin, profluthrin, pyresmethrin, resmethrin, bioresmethrin, cismethrin, tefluthrin, terallethrin, tetramethrin, tralomethrin and transfluthrin; pyrethroid ether insecticides such as etofenprox, flufenprox, halfenprox, protrifenbute and silafluofen; pyrimidinamine insecticides such as flufenerim and pyrimidifen; pyrrole insecticides such as chlorfenapyr; tetronic acid insecticides such as spirodiclofen, spiromesifen and spirotetramat; thiourea insecticides such as diafenthiuron; urea insecticides such as flucofuron and sulcofuron; and unclassified insecticides such as AKD-3088, closantel, crotamiton, cyflumetofen, E2Y45, EXD, fenazaflor, fenazaquin, fenoxacrim, fenpyroximate, FKI-1033, flubendiamide, HGW86, hydramethylnon, IKI-2002, isoprothiolane, malonoben, metaflumizone, metoxadiazone, nifluridide, NNI-9850, NNI-0101, pymetrozine, pyridaben, pyridalyl, Qcide, rafoxanide, rynaxypyr, SYJ-159, triarathene and triazamate.

TABLE 14

NEMATICIDE

Biological: *Bacillus firmus, Paecilomyces lilacinus* str. 251
Chemical: avermectin nematicides, such as abamectin; carbamate nematicides, such as, aldicarb, thiadicarb, carbofuran, carbosulfan, oxamyl, aldoxycarb, ethoprop, methomyl, benomyl, alanycarb; and organophosphorus nematicides, such as, fenamiphos, fensulfothion, terbufos, fosthiazate, dimethoate, phosphocarb, dichlofenthion, isamidofos, fosthietan, isazofos ethoprophos, cadusafos, terbufos, chlorpyrifos, dichlofenthion, heterophos, isamidofos, mecarphon, phorate, thionazin, triazophos, diamidafos, fosthietan and phosphamidon (WO 2012/140212 A2)
Nematophagous fungi useful herein include, but are not limited to, *Arthrobotrys* spp., for example, *Arthrobotrys oligospora, Arthrobotrys superb* and *Arthrobotrys dactyloides*; *Dactylaria* spp., for example, *Dactylaria Candida*; *Harposporium* spp., for example, *Harposporium anguillulae*; *Hirsutella* spp., for example, *Hirsutella rhossiliensis* and *Hirsutella minnesotensis, Monacrosporium* spp., for example, *Monacrosporium cionopagum*; *Nematoctonus* spp., for example, *Nematoctonus geogenius, Nematoctonus leiosporus*;

TABLE 14-continued

NEMATICIDE

*Meristacrum* spp., for example, *Meristacrum asterospermum*; *Harposporium* spp., for example, *Harposporium anguillulae*; *Paecilomyces* spp., for example, *Paecilomyces lilacinus*; *Pochonia* spp., for example, *Pochonia chlamydopora* and *Streptomyces* spp. Nematophagous bacteria useful herein include, but are not limited to, obligate parasitic bacteria, opportunistic parasitic bacteria, *rhizobacteria*, parasporal Cry protein-forming bacteria, endophytic bacteria and symbiotic bacteria. In particular embodiments, the biocontrol agent can be a bacteria species selected from *Actinomycetes* spp., *Agrobacterium* spp., *Allorhizobium* spp., *Arthrobacter* spp., *Alcaligenes* spp., *Aureobacterium* spp., *Azobacter* spp., *Azorhizobium* spp., *Azospirillium* spp., *Beijerinckia* spp., *Bradyrhizobium* spp., *Burkholderia* spp., *Chromobacterium* spp., *Clavibacter* spp., *Clostridium* spp., *Comomonas* spp., *Corynebacterium* spp., *Curtobacterium* spp., *Desulforibtio* spp., *Enterobacter* spp., *Flavobacterium* spp., *Gluconobacter* spp., *Hydrogenophage* spp., *Klebsiella* spp., *Methylobacterium* spp., *Phyllobacterium* spp., *Phingobacterium* spp., *Photorhabdus* spp., *Rhizobium* spp., *Serratia* spp., *Stenotrotrophomonas* spp., *Xenorhadbus* spp. *Variovorax* spp., *Pasteuria* spp., *Pseudomonas* spp., and *Paenibacillus* spp.

TABLE 15

List of Plant Associated Microbes

*Gliocladium virens, Paecilomyces fumosoroseus, Bacillus thuringiensis, Paecilomyces lilacinus, Paenibacillus polymyxa, Neotyphodium lolii, Neotyphodium uncinatum, Ampelomyces quisqualis, Beauvaria bassiana, Azospirillum brasilense, Trichoderma harzianum, Lecanicillium muscarium, Gliocladium catenulatum, Streptomyces ray, Glomus intraradices, Bacillus amyloliquefaciens, Clonostachys Rosea, Beauveria bassiana, Chromobacterium subtsugae, Bacillus subtilus, Trichoderma lignorum, Streptomyces lydicus, Paecilomyces fumorosoroseus, Penicillium bilaii, Bacillus pumilus, Sclerotinia minor, Trichoderma viride, Chaetomium globosum, Pseudomonas fluorescens, Bacillus subtilis, Glomus fasciculatum, Frateuria aurantia, Bacillus megaterium, Thiobacillus Thiooxidans, Metarhizium anisopliae, Verticillium lecanii, Methylobacterium mesophilicum, Methylobacterium organophilum, Methylobacterium extorquens, Bacillus thuringiensis,, Myrothecium verrucaria, Bacillus subtilis, Fusarium oxysporum, Trichoderma asperellum, Coniothyrium minitans, Saccharopolyspora spinosa, Mesorhizobium ciceri, Bradyrhizobium japonicum, Sinorhizobium meliloti, Rhizobium leguminosarum, Bradyrhizobium japnicum, Delftia acidivorans, Agrobacterium radiobacter, Aspergillus flavus, Candida oleophila, Pseudozyma flocculosa, Pythium oligandrum, Ulocladium oudemansii, Phlebia gigantean, Metschnikowia fructicola, Aspergillus niger, Ophiostoma piliferum, Fomes fomentarius, Aschersonia aleyrodis, Beauveria brongniartii, Hirsutella thompsonii, Isaria fumosorosea, Lecanicillium longisporum, Nomuraea rileyi, Sporothrix insectorum, Conidiobolus thromboides, Lagenidium giganteum, Trichoderma gamsii, Trichoderma virens, Burkholderia phytofirmans, Piriformospora indica, Sebacina vermifera, Klebsiella pneumoniae, Pantoea agglomerans, Gluconacetobacter diazotrophicus, Herbaspirillum seropedicae, Methylobacterium fujisawaense, Methylobacterium oryzae, Ralstonia eutropha, Achromobacter piechaudii, Pseudomonas mendocina, Fusarium culmorum, Curvularia protuberata, Bacillus cereus, Bacillus amylilquofaciens, Bacillus mycoides, Bacillus pasteurii, Burkholderia vietnamiensis, Enterobacter aerogenes, Azospirillum lipoferum, Pseudomonas entomophila, Pseudomonas stutzeri, Pseudomonas putida, Pseudomonas syringae, Pseudomonas monteilli, Azotobacter chroococcum, Klebsiella pneumoniae, Burkholderia cepacia, Azorhizobium caulinodans, Aeromonas hydrophila, Serratia liquefaciens, Serratia proteamaculans, Leptodontidium orchidicola, Pleosporales* Unknown, *Verticillium dahliae, Neotyphodium coenophialum, Colletotrichum magna, Colletotrichum musae, Colletotrichum orbiculare, Rhodotorula mucilaginosa, Glomus mosseae, Chryseobacterium indologene, Acinetobacter johnsonii, Chaetomium chiversii, Paraphaeosphaeria quadriseptata, Paecilomyces formosus,* and *Penicillium minioluteum*

SEQUENCE LISTING (1377 sequences)

SEQ ID NO: 1 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aaggcccgggaacgtattcaccgcagcaatgctgatctgcgattactagcaactccgacttcatggggtcgagttgcagaccccaatccgaactgagaccggctttttgagattcgctccacctcacggtatcgcagctcattgtaccggccattgtagcacgtgtgcagcccaagacataaggggcatgatgacttgacgtcgtccccacccctccctt

SEQ ID NO: 2 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Burkholderiaceae
aagacccgggaacgtattcaccgcggcatgctgatccgcgattactaggcgattccagcttcacgcagtcgagttgcagactgcgatccggactacgatcggttttctgggattggctccacctcgcggcttgcaacccctctgttccgaccattgtatgacgtgtgaagccctacccataagggccatgaggacttgacgtcatccccaccttcctccg

SEQ ID NO: 3 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aaggcccgggaacgtattcaccgcagcaatgctgatctgcgattactagagactccgacttcatggggtcgagttgcagaccccaatccgaactgagaccggctttttgagattcgctccacctcacggcatcgcaactctttgtaccggccattgtagcacgtgtgcagcccaagacataaggggcatgatgacttgacgtcgtccccaccttcctccg

SEQ ID NO: 4 - DNA, 220 bp, Unknown
  Description of Unknown: 16S RNA Operational Taxonomic Unit polynucleotide
  Phylum: Proteobacteria; Class: Betaproteobacteria
aagacccgggaacgtattcaccgcgacatgctgatccgcgattactagcgattccgacttcatgcagtcgagttgcagactgcaatccggactacgaccggcttctgggattggctccagctcgcgctttggcaaccctctgtaccggccattgtatgacgtgtgaagccctacccataagggccatgaggacttgacgtcatccccaccttccccggtc

SEQ ID NO: 5 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatggagtcgagttgcagactccaatctgaactgtagagggcgttttttgggattggctccttatcgctaagtggcagccctttgtacgccccattgtagcacgtgtgtagccctgggcataaaggccatgatgacttgaccatcatcccctcttcctc

SEQ ID NO: 6 - DNA, 220 bp, Unknown
  Description of Unknown: 16S RNA Operational Taxonomic Unit polynucleotide
  Phylum: Proteobacteria; Class: Alphaproteobacteria; Order: Sphingomonadales; Family: Sphingomonadaceae
aaggcctgggaacgtattcaccgcggcgtgctgatccgcgattactagcgattccgccttcatgctctcgagttgcagagaacaatccgaactgagacggctttttgggatttgctcactctcgcgagtttgctgccccgttgtcaccgccattgtagcacgtgtgtagcccagcgcgtaagggccatgaggacttgacgtcatccccacctcctccggg

SEQ ID NO: 7 - DNA, 220 bp, Unknown
  Description of Unknown: 16S RNA Operational Taxonomic Unit polynucleotide
  Phylum: Firmicutes; Class: Bacilli; Order: Bacillales; Family: Bacillaceae
aaggcccgggaacgtattcaccgcggcatgctgatccgcgattactagcgattccagcttcatgtaggcgagttgcagcctacaatccgaactgagaatggttttatggggattcgctccacctcgcggtcttgcaaccctttgtaccatccattgtagcacgtgtgtagcccaggtcataaggggcatgatgatttgacgtcatccccaccttcctccg

SEQ ID NO: 8 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Oxalobacteraceae
aaaacccgggaacgtattcaccgcggcatgctgatccgcgattactagcgattccaacttcacgcagtcgagttgcagactgcgatccggactacgatacactttctgggattagctccccctcgcgggttggcggccctctgtatgtaccattgtatgacgtgtgaagccctacccataagggccatgaggacttgacgtcatccccaccttcctccgg

SEQ ID NO: 9 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcacgcagtcgagttgcagactgcgatctgaactgagaggcgtttttgggaattggcctccttatcgctaagtggcagccctttgtacgccccattgtagcacgtgtgtagcctgggcataaaggccatgatgacttgacatcatcccctccttctcacg

SEQ ID NO: 10 - DNA, 220 bp, Unknown
  Description of Unknown: 16S RNA Operational Taxonomic Unit polynucleotide
  Phylum: Proteobacteria; Class: Alphaproteobacteria; Order: Sphingomonadales; Family: Sphingomonadaceae
aaggcctgggaacgtattcaccgcggcgtgctgatccgcgattactagcgattccgccttcatgctctcgagttgcagagaacaatccgaactgagacggcttttggagattagctcaccctcgcggggtcgctgctcactgtcaccgccattgtagcacgtgtgtagcccagcgcgtaagggccatgaggacttgacgtcatccccacttcctccggcc

SEQ ID NO: 11 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Pseudonocardiaceae
aaggcccgggaacgtattcaccgcagcgttgctgatctgcgattactagcgactccgacttcacgcagtcgagttgcagactgcgatccgaactgagaccggctttaagggattcgctccacctcgcggtatcgcacgccctctgtaccagccattgtagcatgtgtgaacgccctggacataaggggcatgatgacttgactcactccccaccttcctc

SEQ ID NO: 12 - DNA, 220 bp, Unknown
  Description of Unknown: 16S RNA Operational Taxonomic Unit polynucleotide
  Phylum: Proteobacteria; Class: Gammaproteobacteria; Order: Xanthomonadales; Family: Xanthomonadaceae
aaggccggaacgtattcgaccgcggcaatgctgatccgcgattactagcgattccgacttcacggagtcgagttgcagactccgatccggacaggatggggtttctgggattggctccggctcgcgccttggcgaccctctgtccccaccattgtagtacgtgtgtagccctggccgtaagggccatgatgacttgacgtcatccccaccttcctccggt

SEQ ID NO: 13 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Oxalobacteraceae
aagacccgggaacgtattcaccgcgacatgctgatccgcgattactagcgattccaacttcatgtagtcgagttgcagactacaatccggacacgattacactttctgggattagctccccctcgcgggttggcggccctctgtatgtaccattgtatgacgtgtgaagccctacccgataagggccatgaggacttgacgtcatccccaccttcctccg

SEQ ID NO: 14 - DNA, 220 bp, Unknown
  Description of Unknown: 16S RNA Operational Taxonomic Unit polynucleotide
  Phylum: Proteobacteria; Class: Gammaproteobacteria; Order: Pseudomonadales; Family: Pseudomonadaceae
aaggcccgggaacgtattcaccgcgacattctgattcgcgattactagcgattccgacttcacgcagtcgagttgcagactgcgatccggactacgatcggttttgtgggattagctccacctcgcggcttggcaaccctctgtaccgaccattgtagcacgtgtgtagcccagcgtaggccatgatgacttgacgtcatccccaccttcctccggtttg

SEQ ID NO: 15 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Mycobacteriaceae
aaggcccgggaacgtattcgaccgcagcgttgctgatctgcgattactagcgactcctacttcacggggtcgagttgcatacccctatccgaactgagaccggctttgaaaggattcgctccacctcacggcatcgcagccctttgtaccggccattgtagcatgtgtgaagccctggacataaggggcatgatgacttgacgtcatcccaccttcctcc

SEQ ID NO: 16 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
agggcccgggaacatattcaccgcagcatgctgatccgcgattactagcaactccgacttcatggggtcgagttgcagaccccaatccgaactgagacaggctttttgagattcgctccgcctcacggcttcgcagctcattgtacctgccattgtagcacgtgtgcagcccaagacataaggggcatgatgacttgacgtcgtccccaccttcctccga

SEQ ID NO: 17 - DNA, 220 bp, Unknown
  Description of Unknown: 16S RNA Operational Taxonomic Unit polynucleotide
  Phylum: Proteobacteria; Class: Betaproteobacteria; Order: Burkholderiales
aagacccgggaacgtattcaccgcggcaagctgatccgcgattactagcgattccgacttcacgcagtcgagttgcagactgcgatccggactacgaccggtttttctgagattagctccccctcgcgggttggcagccctctgtaccggccattgtatgacgtgtgtagccctaccccataagggccatgatgaccctgacgtcatcccccaccttccc

SEQ ID NO: 18 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Micromonosporaceae
aaggcccgggaacgtattcaccgcagcgttgctgatctgcgattactagcgactccgacttcacggggtcgagttgcagaccccgatccgaactgagaccggctttttccggatttcgctccccctcacgggctcgcaacggtttgtaccggccattcgtagcatgcgtgaagccctggacataaggggcagtgatgacttgacgtcatccccaccttcc

SEQ ID NO: 19 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggacgtattcaccgtatcattgcgtggatatacgattactagcgattccagcttcatggagtcgagttgcagactccaatctgaactgagagacgttttttgagattggcttcacatcgctgtgttgctgctctttgtacgtcccattgtagcacgtgtgtagccctgggcataaaggccatgatgacttgacatcatcccctccttcctcg

SEQ ID NO: 20 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Kineosporiaceae
aaggcccgggaacgtattcaccgcagcgttgctgatctgcgattactagcgactccgacttcacggggtcgagttgcagaccccgatccgaactgagaccagcttttttgggattgctccaccttacggtctcgcagccctttgtactggccattgtagcatgcgtgaagcccaagacataaggggcatgatgatttgacgtcatccccaccttcctccg

SEQ ID NO: 21 - DNA, 220 bp, Unknown
  Description of Unknown: 16S RNA Operational Taxonomic Unit polynucleotide
  Phylum: Cyanobacteria; Class: 4C0d-2; Order: SM1D11
aaggcccgggaacgtattcaacgcagcgtgctgatctgcgtttactagcgattccgacttcacgtagtcgagttgcagactacgatccgaactgaggggaggtttgtgggatttgccagacatcgctgccaagcgacccattgtcctcttcccattgtaacacgtgtgtagccctgggacataagggggcgtgatgattttgacgtcatccccaccttcc

SEQ ID NO: 22 - DNA, 220 bp, Unknown
  Description of Unknown: 16S RNA Operational Taxonomic Unit polynucleotide
  Phylum: Firmicutes; Class: Bacilli; Order: Bacillales; Family: Alicyclobacillaceae
aaggcccgggaacgaattcaccgcggcatgctgatccgcgattactagcaattccggcttcatgcaggcgagttgcagcctgcaatccgaacttacgaacggctttatgaagatttggctccacctcgcggtctcgcgtctctttgtaccgcccattgtagcacgtgtgtagcccaagacataaggggcatgatgatttgacgtcatccccgcttcctcc

SEQ ID NO: 23 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Nocardioidaceae
aaggcccgggaacgtattcaccgcagcgttgctgatctgcgattactagcgactccgacttcatggggtcgagttgcagaccccaatccgaactgagaccggctttttgggattcgctcccctcacgggatcggcaggccctttgtaccggccattgtagcatgcgtgaagccctggacataaggggcatgatgacttgacgtcatcccaccttcctccg

SEQ ID NO: 24 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Micromonosporaceae
aaggcccgggaacgtattcaccgcagcgttgctgatctgcgattactagcgactccgacttcacggggtcgagttgcagacccccgatccgaactgagaccggctttttgggattcgctccacctcacggcatcgcaaccctttgtaccggcccattgtagcatgcgtgaagcccctgggacatagggggcatgatgacttgacgtcatccccaccttcc

SEQ ID NO: 25 - DNA, 220 bp, Unknown
  Description of Unknown: 16S RNA Operational Taxonomic Unit polynucleotide
  Phylum: Bacteroidetes; Class: Flavobacteria; Order: Flavobacteriales; Family: Flavobacteriaceae
aaggcccgggaacgtattcaccggatcatggctgatatccgattactagcgattccagcttcacggagtcgagttgcagactccgatccgaactgtgaccggtttattagattcgctcctggtcgcccagtggctgctctctgtaccggccattgtagcacgtgtgtagcccaaggcgtaagggccgtggatgtttgacgtcatccccaccttcctcaca

SEQ ID NO: 26 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Micromonosporaceae
aaggcccgggaacgtattcaccgcagcgttgctgatctgcgattactagcgactccgacttcacggggtcgagttgcagaccccgatccgaactgagaccggctttttgggattcgctcaacctcacggtctcgcagccctttgtaccggccattgtagcatgcgtgaagccctggacataaggggcatgatgacttgacgtcatccccttcctccgagt

SEQ ID NO: 27 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Kineosporiaceae
aaggccctggaacgtattcaccgcagcgttgctgatctgcgattactagcgactccgacttcacggggtcgagttgcagaccccgatccgaactgagaccagctttttgggattcgctccacctcacggtctcgcagccctttgtactggccattgtagcatgcgtgaagcccaagacataaggggcatgatgatttgacgtcgtccccaccttcctccg

SEQ ID NO: 28 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatggagtcgagttgcagactccaatctgaactgagaggcgtttttgagattggctccttatcgctaagtggcagctctttgtccctcccattgtagcacgtgtgtagccctgggcataaaggccatgatgacttgacatcatcccctccttcctcgcg

SEQ ID NO: 29 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
gaaggtccgggacgtattcaccgtatcattgctgatatacggattactagcgattccagcttcacgcagtcgagttgcagactgcgatctgaactgagaagaggttttgggattagctccttgtcgccaagtggcagccctttgtcctctccattgtagcacgtgtgtagccctgggcataaaggccatgatgacttgacatcatcccctcttcctcgcg

SEQ ID NO: 30 - DNA, 220 bp, Unknown
  Description of Unknown: 16S RNA Operational Taxonomic Unit polynucleotide
  Phylum: Acidobacteria; Class: Acidobacteria-5
aaggcccgggaacgtattcaccgctgcttgctgatcagcgattactagcgattccagcttcatgcagtcgagttgcagactgcaatccgaactgagagcggttttttgagattggctccccctcgcgggtttgcgactcatgtgccgcccattgtagtacgtgtgtagccctggacataaaggccatgaggacttgacgtcatccccacccttcctccgg

SEQ ID NO: 31 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatggagtcgagttgcagactccaatctgaactgagaaagagtttttgagattagcgccttgtcaccaagtggcagctctttgtctcttccattgtagcacgtgtgtagccctggggcataaaaggccatgatgacttgacatcatcccccccttcctc

SEQ ID NO: 32 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aaggcccgggaacgtattcgaccgcagcaatgctgatctgcgattactagcaactccgacttcatggggtcgagttgcagacccccaatccgaactgagactaaggcttttttgagattcgctccacctcacggtatcgcagctcattgtacctgccattgtagcacgtgtgcagcccaagacataaggggcatgatgacttgacgtcgtccccaccttc

SEQ ID NO: 33 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aaggcccgggaacgtattcaccgcagcaatgccctgatctgcggattactagcaactccgacttcatggggtcgagttgcagaaccccaatccgaactgagacaggcttttttgagattcgctcaacctcacggtatcgcagctctttgtacctgccattgtagcacgtgtgcagcccaagacataaggggcatgatgacttgacgtcgtcccaccttcc

SEQ ID NO: 34 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Thermomonosporaceae
aaggcccgggaacgtattcaccgcagcgttgctgatctgcgattactagcgactccgacttcatggggtcgagttgcagacccatcgaactgagaccggctttaaggtagttcgctccaccttgcggtatcgcagccctctgtaccggccattgtagcatgtttgcagcccaagacataaggggcatgatgacttgacgtcatccccaccttcctccgag

SEQ ID NO: 35 - DNA, 220 bp, Unknown
  Description of Unknown: 16S RNA Operational Taxonomic Unit polynucleotide
  Phylum: Cyanobacteria; Class: Oscillatoriophycideae; Order: Oscillatoriales; Family: Phormidiaceae
aaggcccgggaacggattcaccgcagtatgctgacctgcgattactagcgattccgccttcatgcaggcgagttgcagcctgcaatctgaactgaggcagggttacgggattagctcgccctcgcggttgctgccctctgtccctacattgtagtacgtgtgtagcccaggacgtaaggggcatgctgacttgacgtcatccccaccttcctccggtttg

SEQ ID NO: 36 - DNA, 220 bp, Unknown
  Description of Unknown: 16S RNA Operational Taxonomic Unit polynucleotide
  Phylum: Cyanobacteria; Class: Oscillatoriophycideae
aagggcccgggaacgaattcgaccgccgtatgctgaccggcgattactagcgattcctccttcatgcaggcgagttgcagcctgcaatctgaactgtgccccagtttatggattggcttgccatcgctggcttgctgccctttgtctggagcattgtagtacgtgtgtagcccaggacgtaaggggcatgctgacttgacgtcatcccaccttcctccgg

SEQ ID NO: 37 - DNA, 220 bp, Unknown
  Description of Unknown: 16S RNA Operational Taxonomic Unit polynucleotide
  Phylum: Acidobacteria; Class: Acidobacteria; Order: Acidobacteriales
aaggcccgggaacgtattcaccgcggcgtgctgatccgcgattactagcgattccaacttcatgcaggcgagttgcagcctacaatccgaactgagaccggcttttctcccgattagctccctctcgcgagatcgcgacggtttgtaccggccattgtagcacgtgtgtggccccagacataaaggccatgctgacttgacgtcatccccaccttcctcc

SEQ ID NO: 38 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatggagtcgagttgcagactccaatctgaactgagaaagggtttttgagattagcgccttgttgccaggtgcagctctttgtcccttcattgtagcacgtgtgtagccctgggcataaaggccatgatgacttgacatcatcccctccttcctccgtc

SEQ ID NO: 39 - DNA, 220 bp, Unknown
  Description of Unknown: 16S RNA Operational Taxonomic Unit polynucleotide
  Phylum: Actinobacteria; Class: Actinobacteria; Order: Solirubrobacterales
aaggcccggacgtattcaccgcggcattgctgatccgcgattactagcaactccaccttcatggaggcgagtttcagcctccaatccgaaccgaggcgcactttatgggattgctccacctcgcggtattgctgccctttgtatgcgccaatgtagcacgtgtgtagccctggacataaggggcatgatgacttgacgtcatccccaccttcctccggtt

SEQ ID NO: 40 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Nocardioidaceae
aaggcccgggaacgtattcaccgcagcgttgctgatctgcgattactagcgactccgacttcatggggtcgagttgcagacccccaatccaactgagaccggctttttgggattcgctccaccttgcggtttcgcagccctttgtaccggccattgtagcatgcttgaagccctggacataaggggcatgaagacttgacgtcatccccaccttcctccg

SEQ ID NO: 41 - DNA, 220 bp, Unknown
  Description of Unknown: 16S RNA Operational Taxonomic Unit polynucleotide
  Phylum: Acidobacteria; Class: Acidobacteria; Order: Acidobacteriales
gaaggcccgggaacgtattcaccgcggcgtgctgatccgcgattactagcgattccaacttcatgcaggcgagttgcagcctacaatccgaactgagaccggctttctccgattagctccccttgcgggctcgcgacggtttgtaccggccattgtagcacgtgtgtggccccagacataaaggccatgctgacttgacgtcatccccacttcctccggt

SEQ ID NO: 42 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Oxalobacteraceae
aagacccgggaacgtattcaccgcgacatgctgatccgcgattactagcgattccaacttcatgtagtcgagttgcagactacaatccgggacacgatacactttctgggattagctcccctcgcgggttggcggccctctgtatgtaccattgtatgacgtgtgaagccctacccataagggccatgaggacttgacgtcatcccaccttcctccggtt

SEQ ID NO: 43 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Rhizobiaceae
aaggcccgggaacgtattcaccgcggcatgctgagtccgcgattactagcgattccaacttcatgcactcgagttgcagagtgcaatccgaactgagatggcttttggagattagctcgacctcgcggtctcgctgcccactgtcaccaccattgtagcacgtgtgtagcccagcccgtaagggccatgaggaccttgactcatccccaccttcctctcg

SEQ ID NO: 44 - DNA, 220 bp, Unknown
  Description of Unknown: 16S RNA Operational Taxonomic Unit polynucleotide
  Phylum: Proteobacteria; Class: Betaproteobacteria; Order: Burkholderiales
aagacccgggaacgtattcaccgcggcaaagctgatccgcgattactagcgattccgacttcacgcagtcgagttgcagactgcgatccggactacgaccgggtttctgggattagctccccctcgcgggttggcagccctcctgtcccggcccattgtatgacgtgtgtagccctacccataagggccatgatgacctgacgtcatccccacccttcct

SEQ ID NO: 45 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Nocardioidaceae
aaggcccgggaacgtattcaccgcagcgttgctgatctgcgattactagcgactccgacttcatggggtcgagttgcagaccccaatccgaactgagaccggctttttgggattcgctccctcgcggcatcgcagccctttgtaccggccattgtagcatgcgtgaagccctggacataaggggcatgatgacttgacgtcatccccaccttcctccggt

SEQ ID NO: 46 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Pseudonocardiaceae
aaggcccgggaacgtattcaccgcagcattgctgatctgcgattactagcgactccaacttcacggggtcgagttgcagaccccgatccgaactgagacccactttaagggtatcgctccacctcacggtctcgcagccctcctgtataggccattgtagcatgtgtgaagccctggacataaggggcatgatgacttgacgtcatccccaccttcctcg

SEQ ID NO: 47 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aaggcccgggaacgtattcaccgcagcgttgctgatctgcgattactagcgactccgacttcatggggtcgagttgcagaccccaatccgaactgagacaggcttttttgagattcgctccaccttgcggtatcgcagctctttgtacctgccattgtagcacgtgtgcagcccaagacataaggggcatgatgacttgacgtcgtccccaccttcctcc

SEQ ID NO: 48 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aaggcccgggaacgtattcaccgcagcaatgctgatctgcgattactagcaactccgacttcatggggtcgagttgcagaccccaatccgaactgagaccggctttttgagattcgctccacctcacggtatcgcagctcattgtaccggccattgtagcacgtgtgcagcccaagacataaggggcatgatgacttgaccgtcgtcccacttcctccgc

SEQ ID NO: 49 - DNA, 220 bp, Unknown
  Description of Unknown: 16S RNA Operational Taxonomic Unit polynucleotide
  Phylum: Acidobacteria; Class: Chloracidobacteria
aagacccgggaacgtattcaccgcagcatgctgatctgcgattactagcgattccagcttcatggagtcgagttgcagactccaatccgaactgagacaagctttttgcgattggctcctctcgcgagtttgcagcgctttgtacttgccattgtagcacgtgtgtagccctggacataaaggccatgaggacttgacgtcatcccccttcctccgtttg

SEQ ID NO: 50 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Oxalobacteraceae
aaggcccgggaacgaattcaccgcgacatgctgatccgcgattactagcgattccaacttcatgcagtcgagttgcagactacaatccggactacgatacactttctgcgattagctccccctcgcgggttgcggcgctctgtatgtaccattgtatgacgtgtgaagccctacccataagggccatgaggacttgacgtcatccccaccttcctccggt

SEQ ID NO: 51 - DNA, 220 bp, Unknown
  Description of Unknown: 16S RNA Operational Taxonomic Unit polynucleotide
  Phylum: Acidobacteria; Class: Solibacteres; Order: Solibacterales; Family: Solibacteraceae
aaggcccgggaacgtattcacggcagcgtgctgatctgccattactagcgattccagcttcatgcaggcgagttgcagcctgcaatccgaactgagagcggttttttgcgattggctcccctcgcgggttcgcggcgcattgtaccgcccattgtagcacgtgtgtagccctggacataaaggccatgaggacttgacgtcatccccaccttcctccagc

SEQ ID NO: 52 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
gaaggcccgggaacgtattcaccgcagcaatgctgatctgcgattactagcaactccgacttcatggggtcgagttgcagaccccaatccgaactgagaccggctttttgagattcgctccacctcacggtttcgcagctctttgtaccggccattgtagcacgtgtgcagcccaagcataaggggcatgatgacttgacgtcgtccccacttcctccga

SEQ ID NO: 53 - DNA, 220 bp, Unknown
  Description of Unknown: 16S RNA Operational Taxonomic Unit polynucleotide
  Phylum: Verrucomicrobia; Class: Spartobacteria; Order: Spartobacteriales; Family: Spartobacteriaceae
aaggcccgggaacgtattcacggcgccgtgctgatgcgccattactagcgattccggcttcatggaggcgagttgcagcctccaatccgaactgggcccagttttactagattcctccacctcgcggtcttggatcgttctgtactgggcattgtagtacgtgtgcagccctggccgtaagggccatactgacttgacgtcgtcccaccttcctcccgtt

SEQ ID NO: 54 - DNA, 220 bp, Unknown
  Description of Unknown: 16S RNA Operational Taxonomic Unit polynucleotide
  Phylum: Gemmatimonadetes; Class: Gemmatimonadetes; Order: Gemmatimonadales; Family: Gemmatimonadaceae
aaggcccgggaacgtattcaccgtggcgatgctgatccacgattactagcaattccagcttcatgccgtcgagttgcagacgacaatccgaactgagggcgggttttgggattgcctcggcattgctgcctcggccccctctgtcccgcccattgtagcacgtgtgtagccctagacgtaaggaccatgatgacttgacgtcgtccccaccttcctccgt

SEQ ID NO: 55 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Actinosynnemataceae
aaggccggacgtatcgaccgcagcgttgctgatctgcgattactagcgactccgacttcacggggtcgagttgcagaccccgatccgaactgagaccggctttatgggattcgctccacctcacggcttagcagccctttgtaccggccattgtagcatgtgtgaagccctggacataaggggcatgatgacttgacgtcatccccaccttcctccgagt

SEQ ID NO: 56 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales; Family: Flexibacteraceae
aaggcccggggaacgtattcaccgcgtcattgctgatacgcgattactagcgattccagcttcacgaagtcgagttgcagacttcgatccgaactgagagcggctttttgagattggcatcctgtcaccaggtagcaaccctctgtaccgcccattgtagcacgtgtgtagccctaggcgtaagggccatgatgacctgacgtcatcccccaccttcctc

SEQ ID NO: 57 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Oxalobacteraceae
aagacccgggaacgtattcaccgcgacatgctgatccgcgattactagcgattccaacttcatggagtcgagttgcagactccaatccggactacgatacactttctgggattagctccccctcgcgggttggcagccctcctgtatgtaccattgtatgacgtgtgaagccctacccactaagggccgatgaggacttgacgtcatccccaccctcctc

SEQ ID NO: 58 - DNA, 220 bp, Unknown
  Description of Unknown: 16S RNA Operational Taxonomic Unit polynucleotide
  Phylum: Acidobacteria; Class: Chloracidobacteria
aagacccgggaacgtattcaccgcagcatgctgatctgcgattactagcgattccagcttcatggagtcgagttgcagactccaatccgaactgagacgagctttttgcgattggctcccccttgcaggtttgcagcgctttgtactcgccattgtagcacgtgtgtagccctggacataaaggccatgaggacttgacatcatcccctccttcctcacg

SEQ ID NO: 59 - DNA, 220 bp, Unknown
  Description of Unknown: 16S RNA Operational Taxonomic Unit polynucleotide
  Phylum: Firmicutes; Class: Bacilli; Order: Bacillales; Family: Bacillaceae
aaggcccgggaacgtattcaccgcggcatgctgatccgcgattactagcgattccagcttcatgtaggcgagttgcagcctacaatccgaactgagaacggtttttatgagatttagctcacctcgcggtcttgcagctctttgtaccgtccattgtagcacgtgtgtagcccaggtcataaggggcatgatgatttgacgtcatccccacttcctccgg

SEQ ID NO: 60 - DNA, 220 bp, Unknown
  Description of Unknown: 16S RNA Operational Taxonomic Unit polynucleotide
  Phylum: Proteobacteria; Class: Alphaproteobacteria; Order: Rhizobiales
aaggcccgggacgtattcaccgcagcatgctgatctgcgattactagcgattccaacttcatgcactcgagttgcagagtgcaatccgaactgagatggcttttggagattagctcgacctcgcggtctcgctgcccactgtcaccaccattgtagcacgtgtgtagccccagcccgtaagggccatgaggacttgacgtcatccccaccttctctcggc

SEQ ID NO: 61 - DNA, 220 bp, Unknown
  Description of Unknown: 16S RNA Operational Taxonomic Unit polynucleotide
  Phylum: Firmicutes; Class: Bacilli; Order: Bacillales; Family: Alicyclobacillaceae
aaggcccgggaacgaattcaccgcggcatgctgatccgcgattactagcaattccggcttcatgcaggcgagttgcagcctgcaatccgaactacgaacggctttatgagattagctccgcctcacggcctcgcgtctctttgtaccgcccattgtagcacgtgtgtagcccaagacataaggggcatgatgatttgacgtcatcccgctcctccggttg

SEQ ID NO: 62 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcacgcagtcgagttgcagactgcgatctgaactgagaaggggtttttgggattagcgccttgtcgccaagtggcagccctttgtcccctccatgtagcacgtgtgtagccctcgggcgataaaggccatgatgacttgacatcatccctccttcctccg

SEQ ID NO: 63 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aaggcccgggaacgtattcaccgcagcaatgctgatctgcgattactagcaactccgacttcatggggtcgagttgcagacccaatccgaactgaggacaggcttttgagattcgctccgcctcacggcttcgcagctcattgtacctgccattgtagcacgtgtgcagcccaagacataaggggcatgattgacttgacgtcgtccccaccttcctccg

SEQ ID NO: 64 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aaggcccgggaacgtattcaccgcagcaatgctgatctgcgattactagcgactccgacttcatggggtcgagttgcagaccccaatccgaactgagaccggctttttgagattcgctccacctcacggtatcgcagctctttgtaccggccattgtagcacgtgtgcacccaagacataaggggcgatgatgacttgacgtcgtccccacccttcctcc

SEQ ID NO: 65 - DNA, 220 bp, Unknown
  Description of Unknown: 16S RNA Operational Taxonomic Unit polynucleotide
  Phylum: Proteobacteria; Class: Gammaproteobacteria; Order: Pseudomonadales; Family: Pseudomonadaceae
aaggccggacgtattcgaccgcgacattctgattcgcgattactagcgattccgacttcacgcagtcgagttgcagactgcgatccggactacgatcggttttatgggattagctccacctcgcggcttggcaaccctctgtaccgaccattgtagcacgtgtgtagcccaggccgtaagggccatgatgacttgacgtcatccccacttcctccggttg

SEQ ID NO: 66 - DNA, 220 bp, Unknown
  Description of Unknown: 16S RNA Operational Taxonomic Unit polynucleotide
  Phylum: Actinobacteria; Class: Actinobacteria; Order: Actinomycetales
aaggcccgggaacgtattcaccgcagcgttgctgatctgcgattactagcgactccaacttcacggggtcgagttgcagaccccgatccgaactgagaccggctttaagggattcgctccacctcacggtatcgcagccctctgtaccggccattgtagcatgtgtgaagccctggacagtaaggggcatgatgacttgaccgtccgtccccaccttcct

SEQ ID NO: 67 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Pseudonocardiaceae
aaggccccggaacgtattcaccgcagcgttgctgatctgcgattactagcgactccgacttcacgcagtcgagttgcagactgcgatccgaactgagaccggctttaagggattcgctccacctcgcggtatcgcagccctctgtaccagccattgtagcatgtgtgaagccctggacataaggggcatgatgacttgacgtcatccccaccttcctccg

SEQ ID NO: 68 - DNA, 220 bp, Unknown
  Description of Unknown: 16S RNA Operational Taxonomic Unit polynucleotide
  Phylum: Actinobacteria; Class: Actinobacteria; Order: Actinomycetales
aaggcccgggaacgtattcaccgcagcgttgctgatctgcgattactagcgactccgacttcacggggtcgagttgcagaccccgatccgaactgagaccggctttttgggtattcgctccacctcacggtatcgcagcccattgtaccggccattgtagcatgcgtgaagccctagacataaggggcatgatgacttgagtcatccccaccttcctcca

SEQ ID NO: 69 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaaggtccgggaacgtattcaccgtatcattgctgatatacgattactagcgattccagcttcacgcagtcgagttgcagactgcgatctgaactgagaaagggtttttgagattagcgccttgtcgccaagtggcagctctttgtcccttccattgtagcacgtgtgtagccctgggcataaaggccatgatgacttgacatcatcccctcttcctcgc

SEQ ID NO: 70 - DNA, 220 bp, Unknown
  Description of Unknown: 16S RNA Operational Taxonomic Unit polynucleotide
  Phylum: Proteobacteria; Class: Betaproteobacteria; Order: Burkholderiales
aagacccgggaacgtattcaccgcggcaagctgatccgcgattactagcgattccgacttcacgcagtcgagttgcagactacgatccggactacgaccgggtttctgggattagctccccctccgcggggttgggcagccctctgtcccggccattgtatgacgtgtgtagccctacccataagggccatgatgacctgacgtcatccccaccttcctc

SEQ ID NO: 71 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcacgcagtcgagttgcagactgcgatccgaactgagaaagggtttttgagattcgcgccttgtcgccaagtggctgctctttgtccctcccattgtagtacgtgtgtagccctgggcataaaggccatgatgacttgacatcatccctccttcctcgcg

SEQ ID NO: 72 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Microbacteriaceae
aagacccgggaacgtattcaccgcagcgttgctgatctgcgattactagcgactccgacttcatgaggtcgagttgcagacctcaatccgaactgggaccggctttttgggattcgctccacctcacggtattgccagccccctttgtaccggccattgtagcatgcgtgaagcccaagacataaggggcatgatgatttgacgtcatccccaccttcct

SEQ ID NO: 73 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aaggcccggaactattcgaccgcagcaatgctgatctgcgattactagcgactccgacttcatggggtcgagttgcagaccccaatccgaactgagaccggctttttgagattcgctccacctcacggtatcgcagctcattgtaccggccattgtagcacgtgtgcagcccaagacataaggggcatgatgacttgacgtcgtccccaccttcctccga

SEQ ID NO: 74 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Thermomonosporaceae
aaagcccgggaacgtattcaccgcagcgttgctgatctgcgattactagcgactccgacttcatggggtcgagttgcagaccccaatccgaactgagaccggctttaagggattcgctccaccttgcggtatcgcagccctctgtaccggccattgtagcatgtttgcagcccaagacataaggggcatgatgacttgacgtcatccccaccttcctccg

SEQ ID NO: 75 - DNA, 220 bp, Unknown
  Description of Unknown: 16S RNA Operational Taxonomic Unit polynucleotide
  Phylum: Actinobacteria; Class: Actinobacteria; Order: Solirubrobacterales
aaggcccgggaacgtattcaccgcggcaatgctgatccgcgattactagcaactccaccttcatgcaggcgggtttcagcctgcaatccgaaccgagacgcgctttgagggattcgctccacctcgcggtatcgcagccctctgtacgcgccaatgtagcacgtgtgtagccctggacataaggcatgatgacttgactcatcccaccttcctccggttt

SEQ ID NO: 76 - DNA, 220 bp, Unknown
  Description of Unknown: 16S RNA Operational Taxonomic Unit polynucleotide
  Phylum: Proteobacteria; Class: Gammaproteobacteria; Order: Xanthomonadales; Family: Xanthomonadaceae
aaggcccgggaacgtattccaccgcagcatagctgatctgcgattactagcgattccgacttcacgaagtcgagttgcagacttcgatccggactggggatcggctttctgggattggctccacctcgcggtattgcaaccctctgtaccgaccattgtagtacgtgtgtagccctgggccgtaagggccatgatgacttgacgcatccccaccttcctc

SEQ ID NO: 77 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtacgggaacgtattcaccgtatcattgctgatatacgattactagcgattccagcttcatggagtcgagttgcagactccaatctgaactgagaaagagtttttgagattagcgccttgtcaccaagtggcagctctttgtctcttccattgtagcacgtgtgtagccctgggcataaaggccatgatgacttgacatcatcccctccttcctcgc

SEQ ID NO: 78 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Micromonosporaceae
aaggcccgggaacgtattcaccgcagcaatgctgatctgcgattactagcgactccgacttcacggggtcgagttgcagaccccgatccgaactgagaccggctttttgggaattcgctccaccttgcggtatcgcagccctttgtaccggccattgtagcatgcgtgaagccctggacataaggggcatgatgacttgacgtcatccccaccttcctcc

SEQ ID NO: 79 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aaggcccggaacgtattcgaccgcagcaatgctgatctgcgattactagcaactccgacttcatggggtcgagttgcagaccccaatccgaactgagacaggctttttgagattcgctccgcctcacggcttcgcagctcattgtacctgccattgtagcacgtgtgcagcccaagacataaggggcatgatgacttgacgtcgtccccacttcctccga

SEQ ID NO: 80 - DNA, 220 bp, Unknown
  Description of Unknown: 16S RNA Operational Taxonomic Unit polynucleotide
  Phylum: Chloroflexi
acaaggcccgggaacatattcaccgcaccgtgctgatgcgcggttactagcaactccgacttcatgcaggcgagttgcagcctacaatccgaactgagaccggctttttgggatccgctccacctcgcggtctcgcttccctctgtaccggccattgtagcgtgtgtgtagcccaggacgtaagagccatgctgacttgacgtcatccccaccttcctcc

SEQ ID NO: 81 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcacgcagtcgagttgcagactgcgatctgaactgagagaaggtttttgagattagctccctgtcaccaggtggcagccctttgtccttccactgtagcacgtgtgtagccctcgggcgataaaggaccatgatgacttgacatcatcccctccttcctc

SEQ ID NO: 82 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aaggcccgggaacgtattcaccgcagcaatgctgatctgcgattactagcaactccgacttcatggggtcgagttgcagaccccaatccgaactgagacaggctttttgagattcgctcaacctcacggtatcgcagctctttgtacctgccattgtagcacgtgtgcagcccaagacataaggggctgatgacttgacgtcgtcccccttcctccgagt

SEQ ID NO: 83 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Nocardioidaceae
aaggcccgggaacgtattcaccgcagcgttgctgatctgcgattactagcgactccgacttcatggggtcgagttgcagacccccaatccgaactgagaccggcttttttgggattcccccccccttacgggatcgcagccctttgtaccggccattgtagcatgcgtgaagccctggacataaggggcatgatgacttgacgtcatccccaccttcctc

SEQ ID NO: 84 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aaggcccgggaacgtattcaccgcagcaatgctgatctgcgattactagcaactccgacttcatggggtcgagttgcagaccccaatccgaactgaacaggctttttgtagattcgctccacctcacggtatcgcagctcattgtacctgccattgtagcacgtgtgcagcccaagacataaggggcatgatgacttgacgtcgtccccaccttcctccg

SEQ ID NO: 85 - DNA, 220 bp, Unknown
  Description of Unknown: 16S RNA Operational Taxonomic Unit polynucleotide
  Phylum: Proteobacteria; Class: Betaproteobacteria; Order: Burkholderiales
aagacccgggaacgtattcaccgcggcaagctgatccgcgattactagcgattccgacttcacgcagtcgagttgcagactgcgatccggactacgaccggttttgggattggctcccctcgcgggttggcagccctctgtaccggccattgtatgacgtgtgtagccctacccataagggccatgaggacctgacgtcatccccaccttcctccggttt

SEQ ID NO: 86 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Oxalobacteraceae
aagacccgggaacgtattcaccgcgacatgctgatccgcgattactagcgattccaacttcatgtagtcgagttgcagactacaatccggactacgatacacttttctgggatagctccccctcgcgggttggcggccctctgtatgtaccattgtatgacgtgtgaagccctacccataagggccatgaggacttgacgtcatccccaccttcctccgg

SEQ ID NO: 87 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Methylobacteriaceae
aaggccctggaacgtattcaccgtggcatgctgatccacgattactagcgattccgccttcatgcactcgagttgcagagtgcaatccgaactgagacggcttttggggatttgctccagatcgctccttcgcgtcccactgtcaccgccattgtagcacgtgtgtagcccatcccgtaagggccatgaggacttgacgtcatccacaccttcctcgcgg

SEQ ID NO: 88 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aaggcccggaacgtattcgaccgcgagcaatgctgatctgcgattactagcaactccgacttcatggggtcgagttgcagacccccaatccgaactgagacaggctttttgagattcgctccacctcacggtatcgcagctcattgtacctgccattgtagcacgtgtgcagcccaagacataaggggcatgatgacttgacgtcgtccccaccttcctt

SEQ ID NO: 89 - DNA, 220 bp, Unknown
  Description of Unknown: 16S RNA Operational Taxonomic Unit polynucleotide
  Phylum: Chloroflexi; Class: Chloroflexi; Order: Roseiflexales; Family: Kouleothrixaceae
aaggcccgggtacgtattcaccgcgccatggctgatacgcggttactagcaactccgccttcatgggggcgagttgcagccccaatctgcactgggccggtccttgggcgattcgcatctccttgcggagtagctgcgcgttgcgaccggcattgtagcgtgtgtgtcggccccagggcgtaagagccatgcggacttgacgtcatccccgccttcctcc

SEQ ID NO: 90 - DNA, 220 bp, Unknown
  Description of Unknown: 16S RNA Operational Taxonomic Unit polynucleotide
  Phylum: Actinobacteria; Class: Actinobacteria; Order: Actinomycetales
aaggcccgggaacgtattcaccgcagcgttgctgatctgcgattactagcgactccgacttcacgggggtcgagttgcagaccccgatccgaactgagaccggctttttgggattcgctccacctcacggtattgcagccctttgtaccggccattgtagcatgcgtgaagcccaagacataaggggcatgatgatttgacgtcatccccaccttcctcc

SEQ ID NO: 91 - DNA, 220 bp, Unknown
  Description of Unknown: 16S RNA Operational Taxonomic Unit polynucleotide
  Phylum: Proteobacteria; Class: Gammaproteobacteria; Order: Chromatiales; Family: Sinobacteraceae
aagacccgggaacgtattcaccgcagcaatgctgatctgcgattactagcgattccgacttcacggagtcgagttgcagactccgatccggactacgatagattttctgggattggctccctctcgcgagttggcttccctctgtatctaccattgtagcacgtgtgtagccctggccataaaggccatgatgacttgacgtcatccccaccttcctccg

SEQ ID NO: 92 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales; Family: Flexibacteraceae
gaggtccgggaacgtattcaccgcgccattgctgatgcgcgattactagcgattccaacttcatgcaggcgagttgcagcctgcaatccgaactgagacgtactttttgtgattggctcactgtcaccagcttgcaacactctgtatacgccattgtagcacgtgtgtagccctgggcgtaagggccatgatgacttgacgtcgtcccctccttcctctc

SEQ ID NO: 93 - DNA, 220 bp, Unknown
  Description of Unknown: 16S RNA Operational Taxonomic Unit polynucleotide
  Phylum: Firmicutes; Class: Bacilli; Order: Bacillales; Family: Paenibacillaceae
aagacccggaacgtattcaccgcggcatgctgatccgcgattactagcaattccgacttcatgcaggcgagttgcagcctgcaatccgaactgagatcggcttataaggatggctccgcttcgcagcttcgcttcccgttgtaccgaccattgtagtacgtgtgtagcccaggtcataaggggcatgatgatttgacgtcatccccacctcctccggctt

SEQ ID NO: 94 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Oxalobacteraceae
aagacccgggaacgtattcaccgcggcatgctgatccgcgattactagcgattccaacttcacgcagtcgagttgcagactgcgatccggacacgattacactttctgggattagctcccctcgcgggttggcggccctctgtatgtaccattgtatgacgtgtgaagccctaccataagggccatgaggacttgacgtcatccccaccttcctccggtt

SEQ ID NO: 95 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aaggcccggaacgtattaccgcgagcaatgctgatctgcgattactagcgactccgacttcatggggtcgagttgcagaccccaatccgaactgagaccggctttttgagattcgctccacctcacggtatcgcagctcattgtaccggccattgtagcacgtgtgcagcccaagacataaggggcatgatgacttgacgtcgtccccaccttcctccga

SEQ ID NO: 96 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Pseudonocardiaceae
aaggcccgggaacgtattcaccgcagcgttgctgatctgcgattactagcgactccaacttcacggggtcgagttgcagaccccgatccgaactgagactcactttaagggattcgctccacctcacggtctcgcagccctctgtatgagccattgtagcatgtgtgaagccctgggacagtaaggggcatgatgacttgacgtcatccccaccttcctc

SEQ ID NO: 97 - DNA, 220 bp, Unknown
  Description of Unknown: 16S RNA Operational Taxonomic Unit polynucleotide
  Phylum: Actinobacteria; Class: Actinobacteria; Order: Actinomycetales
aaggcccgggacgtattcaccgcagcgttgctgatctgcgattactagcgactccgacttcacggggtcgagttgcagaccccgatccgactgagaccggctttttgggattcgctccacctcacggcatcgcaaccctttgtaccggccattgtagcatgcgtgagccctggacataggggcatgatgacttgacgtcatccccaccttcctccgagtt

SEQ ID NO: 98 - DNA, 220 bp, Unknown
  Description of Unknown: 16S RNA Operational Taxonomic Unit polynucleotide
  Phylum: Firmicutes; Class: Bacilli; Order: Bacillales; Family: Alicyclobacillaceae
aaggacccgggaacggaattcaccgcggcatgctgatccgcgattactagcaattccggcttcatgcaggcgagttgcagcctgcaatccgaactacgaacggctttatgagattagctccacctcgcggtctcgcgtctctttgtaccgcccattgtagcacgtgtgtagcccaagacataaggggcatgatgatttgacgtcatccccgccttcctcc

SEQ ID NO: 99 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcacgcagtcgagttgcagactgcgatctgaactgagagaaggtttttgggattagctccttgtcgccaagtggcagccctttgtccttcccattgtagcacgtgtgtagccctggggcataaggccatgatgacttgacatcatccctccttcctcgcg

SEQ ID NO: 100 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Oxalobacteraceae
aagacccgggaacgtattcaccgcgacatgctgatccgcgattactagcgattccaacttcatgcagtcgagttgcagactgcaatccggacttacgatacactttctgggattagctccccctcgcgggttggcggcccccctgtatgtaccattgtatgacgtgtgaaggccctacccataagggccatgaggacttgacgtcatccccaccttccct

SEQ ID NO: 101 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggacgtattcaccgtatcattgctgatatacgattactagcgattccagcttcacgcagtcgagttgcagactgcgatctgaactgagaaagggtttttgggtagttagctccttgtcgccaagtggcagccctttgtcccttccattgtagcacgtgtgtagccctgggcataaaggccatgatgacttgacatcatcccctccttccttc

SEQ ID NO: 102 - DNA, 220 bp, Unknown
  Description of Unknown: 16S RNA Operational Taxonomic Unit polynucleotide
  Phylum: Firmicutes; Class: Bacilli; Order: Bacillales; Family: Bacillaceae
aaggcccggaacgtattcgaccgcggcatgctgatccgcgattactagcgattccagcttcatgtaggcgagttgcagcctacaatccgaactgagaatggttttatgggattggcttgacctcgcggtcttgcagccctttgtaccatccattgtagcacgtgtgtagcccaggtcataaggggcatgatgatttgacgtcatcccaccttcctccggt

SEQ ID NO: 103 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcacgcagtcgagttgcagactgcgatctgaactgagagaaggtttttgggattagctccttgtcgcaagtggcagccctttgtccttcccattgtagcacgtgtgtagccctgggcataaaggccatgatgacttgacatcatccctctcctcgcgtct

SEQ ID NO: 104 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Microbacteriaceae
aagacccgggaacgtattcaccgcagcgttgctgatctgcgattactagcgactccgacttcatgaggtcgagttgcagacctcaatccgaactgggaccggcttttttgggtagttcgctccacctcgcggtattgcagccctttgtaccggccattgtagcatgcgtgaagcccaagacataaggggcatgatgatttgacgtcatcccacttcctcc

SEQ ID NO: 105 - DNA, 220 bp, Unknown
  Description of Unknown: 16S RNA Operational Taxonomic Unit polynucleotide
  Phylum: Proteobacteria; Class: Gammaproteobacteria; Order: Pseudomonadales; Family: Pseudomonadaceae
aaggcccggaacgtatcaccgcgacattctgattcgcgattactagcgattccgacttcacgcagtcgagttgcagactgcgatccggactacgatcggtttatgggattagctccacctcgcggcttggcaaccctttgtaccgaccattgtagcacgtgtgtagcccaggccgtaagggccatgatgacttgacgtcatccccaccttcctccggttt

SEQ ID NO: 106 - DNA, 220 bp, Unknown
  Description of Unknown: 16S RNA Operational Taxonomic Unit polynucleotide
  Phylum: Firmicutes; Class: Bacilli; Order: Bacillales; Family: Paenibacillaceae
aagacccgggaacgtattcaccgcggcatgctgatccgcgattactagcaattccgacttcatgcaggcgagttgcagcctgcaatccgaactgagaccggctttaaggatttgctccacctcgcggttttgctccccgttgtaccggccattgtagtacgtgtgtagcccaggtcataaggggcatgatgatttgacgtcatcccccaccttcctccgg

SEQ ID NO: 107 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aaggcccgggaacgtattcaccgcagcaatgctgatctgcgattactagcaactccgacttcatggggtcgagttgcagaccccaatccgaactgagacaggctttttgagattcgctccacctcacggtatcgcagctcattgtacctgccattgtagcacgtgtgcagcccaaaggcataagggcgatggatgacttgacgtcgtcccacttcctccg

SEQ ID NO: 108 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aaggcccgggaacgtattcaccgcagcaatgctgatctgcgattactagcaactccgacttcatggggtcgagttgcagaccccaatccgaactgagaccggtcttttttgagattcgctccacctcacggtatcgcagctcattgtaccggccattgtagcacgtgtgcagcccaagacataaggggcatgatgacttgacgtcgtccccaccttccct

SEQ ID NO: 109 - DNA, 220 bp, Unknown
  Description of Unknown: 16S RNA Operational Taxonomic Unit polynucleotide
  Phylum: Actinobacteria; Class: Actinobacteria; Order: Actinomycetales
aaggcccgggaacgtattcaccgcagcgttgctgatctgcgattactagcgactccgacttcatggggtcgagttgcagaccccaatccgaactgagaccggtttttggattcgctccctcgcggtttcgcagccctttgtaccggccattgtagcatgcgtgaagcccaagacataaggggcatgatgatttgacgtcatccccacttcctccgagttc

SEQ ID NO: 110 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aaggcccgggaacgtattcaccgcagcaatgctgatctgcgattactagcaactccgacttcatggggtcgagttgcagacccccaatccgaactgagaccggcttttgtagattcgctccacctcacggcatcgcagctcattgtaccggccattgtagcacgtgtgcagcccaacgacataaggggcgatgatgacttgacgtcgtcccaccttcctc

SEQ ID NO: 111 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Kineosporiaceae
aaggcccgggaacgtattcaccgcagcgttgctgatctgcgattactagcgactccgacttcacggggtcgagttgcagaccccgatccgaactgagaccagctttttgggattcgctccaccttacggtctcgcagccctttgtactggccattgtagcatgcgtgaacgcccaagacataaggggcatgatgatttgaccgtcgtcccaccttcctcc

SEQ ID NO: 112 - DNA, 220 bp, Unknown
  Description of Unknown: 16S RNA Operational Taxonomic Unit polynucleotide
  Phylum: Actinobacteria; Class: Actinobacteria; Order: Actinomycetales
aagggcccgggaacgtattcgaccgcagcgttgctgatctgcgattactagcgactccgacttcacggggtcgagttgcagaccccgatccgaactgagaccagctttaagggattcgctccacctcacggtctcgcagccctctgtactggccattgtagcatgtgtgaagccctggacataaggggcatgatgacttgacgtcatcccaccttcctcc

SEQ ID NO: 113 - DNA, 220 bp, Unknown
  Description of Unknown: 16S RNA Operational Taxonomic Unit polynucleotide
  Phylum: Bacteroidetes; Class: Flavobacteria; Order: Flavobacteriales; Family: Flavobacteriaceae
acaaggcccgggaacgtattcaccggatcatggctgatatccgattactagcgattccagcttcacggagtcgagttgcagactccgatccgaactgtgaccggttttatagattcgctcctggtcgcccagtggctgctctctgtaccggccattgtagcacgtgtgtagcccaaggcgtaagggccgtgatgatttgacgtcatcccaccttcctcac

SEQ ID NO: 114 - DNA, 220 bp, Unknown
  Description of Unknown: 16S RNA Operational Taxonomic Unit polynucleotide
  Phylum: Cyanobacteria; Class: Oscillatoriophycideae; Order: Oscillatoriales; Family: Phormidiaceae
aaggcccgggaacggattcaccgcagtatgctgacctgcgattactagcgattccgccttcatgcaggcgagttgcagcctgcaatctggaactgaggcagggtttacggattagctcgccctcgcgggttggctgccctctgtccctaccattgtagtacgtgtgtaggcccaggactaaggggcatgctgacttgacgtcatccccaccttcctccgg

SEQ ID NO: 115 - DNA, 220 bp, Unknown
  Description of Unknown: 16S RNA Operational Taxonomic Unit polynucleotide
aaagtactagtaacatattcaccgcagcatgctgttctgcgattactagcgattccagcttcatatgggcgagtttcagcccataatccgaactaagataatcttaaagatttgctccaatttttaatcactattgcttctcattgtaattatcattgtagcacgtgtgtagcccaactcataagggccatgaagacttgacgtcatccctaccttcctt

SEQ ID NO: 116 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Actinosynnemataceae
aaggcccgggaacgtattcaccgcagcgttgctgatctgcgattactagcgactccgacttcacggggtcgagttgcagacccccgatccgaactgagaccggctttatgggattcgctccacctcacggtttagcagccctttgtacccggccattgtagcatgtgtgaagcccctggacataagggggcatgatgacttgacgtcatccccaccttcc

SEQ ID NO: 117 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Burkholderiaceae
aagacccgggaacgtattcaccgcggcatgctgatccgcgattactagcgattccagcttcacgtagtcgagttgcagactacgatccggactacgatgcatttctgggattagctccacctcgcggcttggcaaccctctgtatgcaccattgtatgacgtgtgaagccctacccactaacgggccatgaggacttgacgtcatcccaccttcctccgt

SEQ ID NO: 118 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Brevibacteriaceae
aaggccgggaacgtattcaccgcagcgttgctgatctgcgattactagcgactccgacttcacgtagtcgaattgcagactacgatccgaactgagactggctttaagggattcgcttgccctcacgggttcgcctctctctgtaccagccattgtagcatgcgtgaagcccaagacataaagggcatgatgatttgacgtcatccccaccttcctccga

SEQ ID NO: 119 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Micromonosporaceae
aaggcccgggaacgtattcaccgcagcgttgctgatctgcgattactagcgactccgacttcacggggtcgagttgcagaccccgatccgaactgagaccggcttttgggattcgctccaccttacggtatcgcagccctttgtaccggccattgtagcatgcgtgaagccctgggacataagggggcatgatgacttgacgtcatccccaccttcctcg

SEQ ID NO: 120 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Oxalobacteraceae
aagacccgggaacgtattcaccgcgacatgctgatccgcgattactagcgattccaacttcatgtagtcgagttgcagactacaatccggactacgatacactttctgggattagctccccctcgcgggttggcagccctctgtatgtaccattgtatgacgtgtgaagcctacccataaggggccatgaggacttgacgtcatccccaccttcctccgg

SEQ ID NO: 121 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Oxalobacteraceae
aagacccgggaacgtattcaccgcggcatgctgatccgcgattactagcgattccaacttcacgcagtcgagttgcagactgcgatccggactacgatgcactttctgggattagctcccctcgcggttggcggccctctgtatgcaccattgtatgacgtgtgaagccctacccataagggccatgaggacttgacgtcatcccaccttcctccggttt

SEQ ID NO: 122 - DNA, 220 bp, Unknown
  Description of Unknown: 16S RNA Operational Taxonomic Unit polynucleotide
  Phylum: Firmicutes; Class: Bacilli; Order: Bacillales; Family: Bacillaceae
aaggcccgggaacgtattcaccgcggcatgctgatccgcgattactagcgattccagcttcatgtaggcgagttgcagcctacaatccgaactgagaatggtttatgggattggcttgacctcgcggtcttgcagccctttgtaccatccattgtagcacgtgtgtagcccaggtcataaggggcatgatgatttgacgtcatcccactacctcccgccg

SEQ ID NO: 123 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aaggcccgggaacgtattcaccgcagcaatgctgatctgcgattactagcaactccgacttcatggggtcgagttgcagaccccaatccgaactagacaggcttttttgagattcgctccgcctcacggcttcgcagctcattgtacctgccattgtagcacgtgtgcagcccaagacataagggggcatgatgacttgacgtcgtccccaccttcctcc

SEQ ID NO: 124 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Propionibacteriaceae
aagccccgggaacgtattcaccgcagcgttgctgatctgcgattactagcgactccgacttcatgaggtcgagttgcagaccccaatccgaactgagaccggctttccgagattcgctcaccctcacaggctcgccactctctgtaccagccattgtagcatgcgtgaagccctgacataaggggcatgatgacttgacgtcatcccaccttcctccgag

SEQ ID NO: 125 - DNA, 220 bp, Unknown
  Description of Unknown: 16S RNA Operational Taxonomic Unit polynucleotide
  Phylum: Cyanobacteria; Class: Oscillatoriophycideae; Order: Chroococcales; Family: Dermocarpellaceae
aaggcccgggaacggattcaccgcagtatgctgacctgcgattactagcgattccgccttcatgcaggcgagttgcagcctgcaatctgaactgaggcagggtttacgggattagctcgcctcgcgggttgctgccctctgtccctacattgtagtacgtgtgtagcccaggacgtaagggcatgctgacttgactcatcccacttcctccggtttgcac

SEQ ID NO: 126 - DNA, 220 bp, Unknown
  Description of Unknown: 16S RNA Operational Taxonomic Unit polynucleotide
  Phylum: Cyanobacteria; Class: Nostocophycideae; Order: Nostocales; Family: Nostocaceae
aaggcccgggaacgaattcactgcagtatgctgacctgcaattactagcgattcctccttcacgaagctgagttgcaagcttcgatctgaactgagctacgatttccgggatttgcttgctatcgctagcttgctgccctctgttcgtagcattgtagtacgtgtgtagcccaagacgtaaggggcatgctgacttgactcatccccaccttctccggtg

SEQ ID NO: 127 - DNA, 220 bp, Unknown
  Description of Unknown: 16S RNA Operational Taxonomic Unit polynucleotide
  Phylum: Proteobacteria; Class: Gammaproteobacteria; Order: Pseudomonadales; Family: Moraxellaceae
aaggccgggaacgtattcaccgcggcattctgatccgcgattactagcgattccgacttcatggagtcgagttgcagactccaatccggactacgatcggctttttgagattagcatcctatcgctaggtagcaaccctttgtaccgaccattgtagcacgtgtgtagccctggtcgtaagggccatgatgacttgacgtcgtccccgccttcctccagt

SEQ ID NO: 128 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggcccggaacgtattcgaccgtatcattgctgatatacgattactagcgattccagcttcatggagtcgagttgcagactccaatctgaactgagaaagagtttttgagattagcgccttgtcgccaagtggcagctctttgtctcttccattgtagcacgtgtgtagccctgggcataaaggccatgatgacttgacatcatcccctcttcctcgcg

SEQ ID NO: 129 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Micromonosporaceae
aaggcccgggaacgtattcaccgcagcgttgctgatctgcgattactagcgactccgacttcacggggtcgagttgcagaccccgatccgaactgagaccggctttttccgattcgctcccccctcacgggctcgcaacggtttgtaccggccattgtagcatgcgtgaagccctggacataagggggcatggatgacttgacgtcatccccaccttcct

SEQ ID NO: 130 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Burkholderiaceae
aagacccgggaacgtattcaccgcggcatgctgatccgcgattactagcgattccaggcttcacgtagtcgagttgcagactacgatccggactacgatgcatttctgggattggctccacctcgcggcttggcaaccctctgttccgaccattgtatgacgtgtgaagccctacccataagggccatgaggacttgacgtcatccccacctcctccggt

SEQ ID NO: 131 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aaggcccgggaacgtattcaccgcagcaatgctgatctgcgattactagcgactccgacttcatggggtcgagttgcagaccccaatcgaactgagaccggctttttgtagatcgctccacctcacggcttcgcagctcattgtaccggccattgtagcacgtgtgcagcccaagacataaggggcatgatgacttgacgtcgtccccacccttcctccg

SEQ ID NO: 132 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aaggcccgggaacgtattcaccgcagcaatgctgatctgcgattactagcaactccgacttcatggggtcgagttgcagacccccaataccggaactgagaccggcttttttgagattcgctccacctcacggtttcgcagctctttgtaccggccattgtagcacgtgtgcagcccaagacataaggggcatgatgacttgacgtcgtcccacttcctc

SEQ ID NO: 133 - DNA, 220 bp, Unknown
  Description of Unknown: 16S RNA Operational Taxonomic Unit polynucleotide
  Phylum: Actinobacteria; Class: Actinobacteria; Order: Actinomycetales
aaggcccgggaacgtattcaccgcagcgttgctgatctgcgattactagcgactccgacttcatggggtcgagttgcagaccccaatccgaactgagaccggcttttgggaattcgctccatcttcgcgatttcgcagccctttgtaccggccattgtagcatgcgtgaagccctggacataaggggcatgatgacttgacgtcatccccaccttcctcc

SEQ ID NO: 134 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aaggcccgggaacgtattcaccgcagcactgctgatctgcgattactagcaactcgacttcatgggggtcgagttgcagaccccaatccgaactgagacaggctttttgagattcgctccgcctcacggcttcgcagctcattgtacctgccattgtagcacgtgtgcagcccaagacataaggggcatgatgacttgacgtcgtccccaccttcctccg

SEQ ID NO: 135 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcacgcagtcgagttgcagactgcgatctgaactgagaaggggttttttgggattagcgccttgtcgccaagtggcagccctttgtcccctccattgtagcacgtgtgtagccctgggcataaaggccatgatgacttgacatactcccctccttcctcc

SEQ ID NO: 136 - DNA, 220 bp, Unknown
  Description of Unknown: 16S RNA Operational Taxonomic Unit polynucleotide
  Phylum: Firmicutes; Class: Bacilli; Order: Bacillales; Family: Paenibacillaceae
aagacccgggaacgtattcaccgcggcatgctgatccgcgattactagcaattccgacttcatgcaggcgagttgcagcctgcaatccgaactgagaccggcttataaagattcgctccgcctcgcggcttcgcttcccgttgtaccggccattgtagtacgtgtgtagcccaggtcataaggggcatgatgatttgacgtcatcccaccttcctccggg

SEQ ID NO: 137 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccaggcttcacgcagtcgagttgcagactgcgatctgaactgagaaggggtttttgggattagctccttgtcgccaagtggcagcccctttgtccttcccattgtagcacgtgtgtagccctggggcataaaggccatgatgacttgacatcatcccctccttcct

SEQ ID NO: 138 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Burkholderiaceae
aatacccgggaacgtattcaccgcggcatgctgatccgcgattactagcgattccagcttcacgtagtcgagttgcagactacgatccggactacgatgcattttctgggattggctccacctcgcggcttggcaaccctctgtatgcaccattgtatgacgtgtgaagccctacccataagggccatgaggacttgacgtcatccccaccttcctccgg

SEQ ID NO: 139 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aaggcccgggaacgtattcaccgcagcaatgctgatctgcgattactagcaactccgacttcatggggtcgagttgcagaccccatccgaactgagacaggctttttgtagattcgctccacctcacggtatcgcagctcattgtacctgccattgtagcacgtgtgcagcccaagacataaggggcatgatgacttgacgtcgtcccacctctccggct

SEQ ID NO: 140 - DNA, 220 bp, Unknown
  Description of Unknown: 16S RNA Operational Taxonomic Unit polynucleotide
  Phylum: Proteobacteria; Class: Betaproteobacteria; Order: Burkholderiales
aagacccgggaacgtattcaccgcggcaagctgatccgcgattactagcgattccgacttcacgcagtcgagttgcagactgcgatccggactacgaccggttttctgggattggctccccctcgcgggttggcagccctctgtaccggcccattgtatgacgtgtgtagccctacccataaggggccatgagacctgacgtcatccccaccttcctccg

SEQ ID NO: 141 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aaggcccgggaacgtattcaccgcagcaatgctgatctgcgattactagcaactccgacttcatggggtcgagttgcagaccccaatccgaactgagaccggctttttgagattcgctccacctcacggtttcgcagctcattgtaccggccattgtagcacgtgtgcagcccaagacataaggggcatgatgacttgacgtcacctcaccttcctcccg

SEQ ID NO: 142 - DNA, 220 bp, Unknown
  Description of Unknown: 16S RNA Operational Taxonomic Unit polynucleotide
  Phylum: Firmicutes; Class: Bacilli; Order: Bacillales; Family: Bacillaceae
aaggcccgggaacgtattcaccgcggcatgctgatccgcgattactagcgattccagcttcatgtaggcgagttgcagcctacaatccgaactgagaatggttttatgggattggcttgacctcgcggcttgcagcccctttgtaccatccattgtagcacgtgtgtagcccaggtcataaggggcatgatgatttgacgtcatccccaccttcctccgg

SEQ ID NO: 143 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Micromonosporaceae
aaggcccgggaacgtattcaccgcagcgttgctgatctgcgattactagcgactccgacttcacggggtcgagttgcagaccccgatccgaactgagaccggctttttgggatttcgctccacctcacggtatcgcagccctttgtaccggcccattgtagcatgcgtgaagccccgggacataagggggcatgatgacttgacgtcatccccaccttcc

SEQ ID NO: 144 - DNA, 220 bp, Unknown
  Description of Unknown: 16S RNA Operational Taxonomic Unit polynucleotide
  Phylum: Cyanobacteria; Class: Oscillatoriophycideae; Order: Oscillatoriales; Family: Phormidiaceae
aaggcccgggaacgaattcaccgccgtatggctgaccggcgattactagcgattccgccttcatgcaggcgagttgcagcctgcaatctgaactgaggcagggtttacgggattagctcgccctcgcgggttggctgccctctgtccctaccattgtagtacgtgtgtagcccaggacgtaaggggcatgctgacttgacgtcatccccaccttcctccg

SEQ ID NO: 145 - DNA, 220 bp, Unknown
  Description of Unknown: 16S RNA Operational Taxonomic Unit polynucleotide
  Phylum: Firmicutes; Class: Bacilli; Order: Bacillales; Family: Bacillaceae
aaggcccggaacgtattcaccgcggcatgctgatccgcgattactagcgattccagcttcacgcagtcgagttgcagactgcgatccgaactgagaacagatttgtgggattggctaaaccttgcggtctcgcagccctttgttctgtccattgtagcacgtgtgtagcccaggtcataaggggcatgatgatttgacgtcatccccaccttctccggtt

SEQ ID NO: 146 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Oxalobacteraceae
aagacccgggaacgtattcaccgcgacatgctgatccgcgattactagcgattcaaacttcatgcagtagagttgcagactgcaatccggactacgatacactttctgggattagctcccccctcgcgggttggcggcccctctgtatgtaccattgtatgacgtgtgaagccctacaataagggccatgaggacttgacgtcatcccccaccttcctcc

SEQ ID NO: 147 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Microbacteriaceae
aaggcccgggaacgtattcaccgcagcgttgctgatctgcgattactagcgactccggacttcatgaggtcgagttgcagacctcaatccgaactgagaccggctttttgggattcgctccaccttacggtatgcagcccctttgtaccggccattgtagcatgcgtgaagcccaagacataaggggcatgatgatttgacgtcatccccaccttcctcc

SEQ ID NO: 148 - DNA, 220 bp, Unknown
  Description of Unknown: 16S RNA Operational Taxonomic Unit polynucleotide
  Phylum: Actinobacteria; Class: Actinobacteria; Order: Actinomycetales
aaggcccgggaacgtattcaccgcagcgttgctgatctgcgattactagcgactccgacttcacggggtcgagttgcagacccccgatccgaactgagaccggctttttgggtattcgctccacctcacggcatcgcaaccctttgtacccggccattgtagcatgcgtgaagccctgggacataagggggcatgatgacttgacgtcatcccaccttcc

SEQ ID NO: 149 - DNA, 220 bp, Unknown
  Description of Unknown: 16S RNA Operational Taxonomic Unit polynucleotide
  Phylum: Proteobacteria; Class: Betaproteobacteria; Order: Burkholderiales
aagacccgggaacgtattcaccgcggcaagctgatccgcgattactagcgattccgacttcacgcagtcgagttgcagactgcgatccggactacgaccggttttctgggattgggctcccctcgcgggttgggcagccctcctgtaccggcccattgtatgacgtgtgtagccctacccataagggccatgaggacctgacgtcatccccacccttcct

SEQ ID NO: 150 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Kineosporiaceae
aaggcccgggaacgtattcaccgcagcgttgctgatctgcgattactagcgactccgacttcacggggtcgagttgcagaccccgatccgaactgagaccagcttttgggattcgctcccaccttacggtctcgcagccctttgtactggccattgtagcatgcgtgaagcccaagacataaggggcatgatgatttgacgtcatccccaccttcctccc

SEQ ID NO: 151 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcacgcagtcgagttgcagactgcgatctgaactgagagaaggtttttgggattagctccttgtcgccaagtggcagcccctttgtccttccattgtagcacgtgtgtagccctgggcataaaggccatgatgacttgacatcatcccccttcctcacgt

SEQ ID NO: 152 - DNA, 220 bp, Unknown
  Description of Unknown: 16S RNA Operational Taxonomic Unit polynucleotide
  Phylum: Proteobacteria; Class: Gammaproteobacteria; Order: Pseudomonadales; Family: Moraxellaceae
aaggcccgggaacgtattcaccgcggcattctgatccgcgattactagcgattccgacttcatggagtcgagttgcagactccaatccggactacgattccggcttttttgagattagcatcctatcgctaggtagcaaccctttgtaccgaccattgtagcacgtgtgtagccctggtcgtaaggggccatgatgacttgacgtcgtccccgcttcctc

SEQ ID NO: 153 - DNA, 220 bp, Unknown
  Description of Unknown: 16S RNA Operational Taxonomic Unit polynucleotide
  Phylum: Actinobacteria; Class: Actinobacteria; Order: Actinomycetales
aaggcccgggaacgtattcaccgcagcgttgctgatctgcgattactagcgactccgacttcacggggtcgagttgcagaccccgatccgaactgagaccgcttttgggtagttcgctccacctcacggcatcgcaaccctttgtaccggccattgtagcatgcgtgaagccctggacataaggggcgatgatgacttgacgtcatccccaccttcctcc

SEQ ID NO: 154 - DNA, 220 bp, Unknown
  Description of Unknown: 16S RNA Operational Taxonomic Unit polynucleotide
  Phylum: Firmicutes; Class: Bacilli; Order: Bacillales; Family: Staphylococcaceae
aatacccgggaacgtattcaccgtagcatgctgatctacgattactagcgattccagcttcatgtagtcgagttgcagactacaatccgaactgagaacaactttatgggatttgcttgacctcgcggtttcgctaccctttgtattgtccattgtagcacgtgtgtagcccaaatcataaggggcatgatgatttgacgtcatccccaccttcctccgg

SEQ ID NO: 155 - DNA, 220 bp, Unknown
  Description of Unknown: 16S RNA Operational Taxonomic Unit polynucleotide
  Phylum: Firmicutes; Class: Bacilli; Order: Lactobacillales; Family: Streptococcaceae
aagacccgggaacgtattcaccgcggcgtgctgatccgcgattactagcgattccgacttcatgtaggcgagttgcagcctacaatccgaactgagactggctttaagagattagcttgccgtcaccgacttgcgactcgttgtaccagccattgtagcacgtgtgtagcccagggtcataaggggcatgatgatttgacgtcatccccaccttcctccg

SEQ ID NO: 156 - DNA, 220 bp, Unknown
  Description of Unknown: 16S RNA Operational Taxonomic Unit polynucleotide
  Phylum: Cyanobacteria; Class: Oscillatoriophycideae; Order: Oscillatoriales; Family: Phormidiaceae
aaggcccgggaacggattcaccgcagtatgctgacctgcgattactagcgattccgccttcatgcaggcgagttgcagcctgcaatctgaactgaggggcagggttttacgggattagctcgccctcgcgggttggctgccctctgtccctaccattgtagtacgtgtgtagcccaggacgtaaggggcatgctgacttgacgtcatccccaccttcctc

SEQ ID NO: 157 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Burkholderiaceae
aagaccggaacgtattcaccgcggcatgctgatccgcgattactagcgattccagcttcacgcacccgagttgcagagtgcgatccggactacgaccggtttctgggattggctccacctcgcggcttggctacccctctgttccgaccattgtatgacgtgtgaagccctacccataaggggccatgaggacttgacgtcatccccaccttcctccggt

SEQ ID NO: 158 - DNA, 220 bp, Unknown
  Description of Unknown: 16S RNA Operational Taxonomic Unit polynucleotide
  Phylum: Actinobacteria; Class: Actinobacteria; Order: Actinomycetales
aaggcccgggaacgtattcaccgcagcgttgctgatctgcgattactagcgactccgacttcacggggtcgagttgcagaccccgatccgaactgagaccggctttttggggtattcgctccacctcacggtatcgcagcccctttgtacccggccattgtagcatgcgtgaagccctggacagtaaggggggcatgatgacttgacgtcatccccacct

SEQ ID NO: 159 - DNA, 220 bp, Unknown
  Description of Unknown: 16S RNA Operational Taxonomic Unit polynucleotide
  Phylum: Proteobacteria; Class: Gammaproteobacteria; Order: Pseudomonadales; Family: Moraxellaceae
aaggcccgggaacgtattcaccgcggcattctgatccgcgattactagcgattccgacttcatggagtcgagttgcagactccaatccggactacgatcggctttttgagattagcatcctatcgctaggtagcaaccccttgtaccgaccattgtagcacgtgtgtagccctggtcgtaaggggccatgatgacttgacgtcgtcccgcctcctccacg

SEQ ID NO: 160 - DNA, 220 bp, Unknown
  Description of Unknown: 16S RNA Operational Taxonomic Unit polynucleotide
  Phylum: Proteobacteria; Class: Gammaproteobacteria; Order: Pseudomonadales; Family: Pseudomonadaceae
aagacccgggaacgtattcaccgcgacattctgattcgcgattactagcgattccgacttcacgcagtcgagttgcagactgcgatccggactacgatcggtttatgggattagctccacctcgcggcttggcaaccctctgtaccgaccattgtagcacgtgtgtagcccaggccgtaagggccatgatgacttgacgtcatccccacctcctccgttg

SEQ ID NO: 161 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Bradyrhizobiaceae
aaggcccgggaacgtattcaccgtggcgtgctgatccacgattactagcgattccaacttcatgggctcgagttgcagagcccaatccgaactgagacggctttttgagatttgcgaagggtcgccccttagcatcccactgccaccgccattgtagcacgtgtgtagcccagcccgtaagggccatgaggacttgacgtcatccccaccttcctccggc

SEQ ID NO: 162 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Propionibacteriaceae
aaggctcgggaacgtattcaccgcagcgttgctgatctgcgattactagcgactccgacttcatggggtcgagttgcagaccccaatccgaactgagactggctttttgggattcgctcgaccttgcggttttgcagccctttgtaccagccattgtagcatgcgtgaagccctggacttaaggggcatgatgacttgacgtcatccccaccttcctccg

SEQ ID NO: 163 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Comamonadaceae
aagaccggaacgtattcaccgtgacattctgatccacgattactagcgattccgacttcacgcagtcgagttgcagactgcgatccggactacgaccggttttatgggattagctccccctcgcgggttggcaaccctttgtaccagccattgtatgacgtgtgtagccccacctataagggccatgaggacttgacgtcatccccaccttcctccggtt

SEQ ID NO: 164 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Micrococcaceae
aaggcccggaacgtattcaccgcagcgttgctgatctgcgattactagcgactccgacttcatggggtcgagttgcagaccccaatccgaactgagaccggctttttgggattagctccacctcacagtatcgcaaccctttgtaccggccattgtagcatgcgtgaagcccaagacataaggggcatgatgatttgacgtcgtcccaccttcctccgag

SEQ ID NO: 165 - DNA, 220 bp, Unknown
  Description of Unknown: 16S RNA Operational Taxonomic Unit polynucleotide
  Phylum: Proteobacteria; Class: Betaproteobacteria; Order: Burkholderiales
aagacccgggaacgtattcaccgcggcaagctgatccgcgattactagcgattccgacttcacgcagtcgagttgcagactgcgatccggactacgaccggttttctgggattggctccccctcgcgggttggcgaccctctgtaccggccattgtatgacgtgtgtagccctacccataagggccatgaggacctgacgtcatccccacctttcccccc

SEQ ID NO: 166 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Hyphomicrobiaceae
aaggcccgggaacgtattcaccgcagcgtgctgatctgcgattactagcgattccaacttcatggggtcgagttgcagaccccaatccgaactgagacggctttttgagatttgcgaagggtcgcccctttgcatcctctgtcaccgccattgtagcacgtgtgtagcccagccgtaagggccatgaggacttgacgtcatccccaccttcctcccggct

SEQ ID NO: 167 - DNA, 220 bp, Unknown
  Description of Unknown: 16S RNA Operational Taxonomic Unit polynucleotide
  Phylum: Proteobacteria; Class: Alphaproteobacteria; Order: Sphingomonadales; Family: Sphingomonadaceae
aaggcctgggaacgtattcaccgcggcgtgctgatccgcgattactagcgattccgccttcatgctctcgagttgcagagaacaatccgaactgagacggcttttgggatttgctcactctcgcgagtttgctgcccattgtcaccgccattgtagcacgtgtgtagcccagcgcgtaagggccatgaggacttgacgtcacctccctaccttccgtcgg

SEQ ID NO: 168 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Comamonadaceae
aagacccgggaacgtattcaccgtgacattctgatccacgattactagcgattccgacttcacgcagtcgagttgcagactgcgatccggactacgaccggttttatgggattagctcccccctcgcgggttggcagcctttgtaccggccattgtatgacgtgtgtagccccacctataagggccatgaggacttgacgtcatcccccacccttcctcc

SEQ ID NO: 169 - DNA, 220 bp, Unknown
  Description of Unknown: 16S RNA Operational Taxonomic Unit polynucleotide
  Phylum: Armatimonadetes; Class: Chthonomonadetes; Order: Chthonomonadales; Family: Chthonomonadaceae
aaggtccgggaacgtattcaacgcagtttagctgacctgcgtttactagcgattccggcttcatgcaggcgagttgcagcctgcaatccgaactgagaacggatttctgagattgcctccacctcacggtctcggatccctctgtttaccgtccattgtagcatgtttgtagcccaggatgtaagggccatgctgacttgacgtcatcctcaccttcctc

SEQ ID NO: 170 - DNA, 220 bp, Unknown
  Description of Unknown: 16S RNA Operational Taxonomic Unit polynucleotide
  Phylum: Proteobacteria; Class: Gammaproteobacteria; Order: Pseudomonadales; Family: Pseudomonadaceae
aaggcccgggaacgtattcgaccgcgacattctgattcgcgattactagcgattccgacttcacgcagtcgagttgcagactgcgatccggactacgattcggtttttatgggattagctccacctcgcggcttggcaaccctttgtaccgaccattgtagcacgtgtgtagcccaggccgtaagggccatgatgacttgacgtcatccccaccttcctc

SEQ ID NO: 171 - DNA, 220 bp, Unknown
  Description of Unknown: 16S RNA Operational Taxonomic Unit polynucleotide
  Phylum: Actinobacteria; Class: Actinobacteria; Order: Actinomycetales
aaggcccgggaacgtattcaccgcagcgttgctgatctgcgattactagcgactccgacttcatggggtcgagttgcagaccccaatccgaactgagaccggctttttggattcgctctatcttgcgatttcgcagccctttgtaccggccattgtagcatgcgtgaagccctaggcataaggggcatgatgacttgacgtcatccccacttcctccggt

SEQ ID NO: 172 - DNA, 220 bp, Unknown
  Description of Unknown: 16S RNA Operational Taxonomic Unit polynucleotide
  Phylum: Proteobacteria; Class: Gammaproteobacteria; Order: Pseudomonadales; Family: Pseudomonadaceae
aaggcccgggaacgtattcaccgtgacattctgattcacgattactagcgattccgacttcacgcagtcgagttgcagactgcgatccggactacgatcggttttatgggatttagcctccacctcgcggcttggcaaccctttgtaccgaccattgtagcacgtgtgtagcccaggccgtaagggccatgatgacttgacgtcatccccaccttcctcc

SEQ ID NO: 173 - DNA, 220 bp, Unknown
  Description of Unknown: 16S RNA Operational Taxonomic Unit polynucleotide
  Phylum: Actinobacteria; Class: Actinobacteria; Order: Actinomycetales
aaggcccgggaacgtattcaccgcagcgttgctgatctgcgattactagcgactccgacttcatggggtcgagttgcagaccccaatccgaactgagaccggctttttgggattcgctccacctcgcggtttagcagccctttgtaccggccattgtagcatgtgtgcagcccaagacataaggggcatgatgatttgacgtcatccccacttcctcccg

SEQ ID NO: 174 - DNA, 220 bp, Unknown
  Description of Unknown: 16S RNA Operational Taxonomic Unit polynucleotide
  Phylum: Firmicutes; Class: Bacilli; Order: Bacillales; Family: Bacillaceae
aaggcccgggaacgtattcaccgcggcatgctgatccgcgattactagcgattccggcttcatgtaggcgagttgcagcctacaatccgaactgagaatggttttatgggattggctagaccttgcggttttgcagccctttgtaccatccattgtagcacgtgtgtagcccaggtcataaggggcatgatgatttgacgtcatccccaccttcctccga

SEQ ID NO: 175 - DNA, 220 bp, Unknown
  Description of Unknown: 16S RNA Operational Taxonomic Unit polynucleotide
  Phylum: Proteobacteria; Class: Alphaproteobacteria; Order: Sphingomonadales; Family: Sphingomonadaceae
aaggcctgggaacgtattcaccgcggcgtgctgatccgcgattactagcgattccgccttcatgctctcgagttgcagagaacaatccgaactgagacggcttttggagattagctcacctcgcgggtttgcgccctctgtcaccgccattgtagcacgtgtgtagcccagcgcgtaaggccatgaggacttgacgtcatccccacttcctccggcttat

SEQ ID NO: 176 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Rhizobiaceae
aaggcccgggaacgtattcaccgcggcatgctgatccgcgattactagcgattccaacttcatgcactcgagttgcagagtgcaatcccgaacttgagatggcttttggacgattagctcgacatcgctgtctcgctgcccactgtcaccaccattgtagcacgtgtgtagcccagcccgtaagggccatgaggacttgacgtcatccccacttcctctc

SEQ ID NO: 177 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Brucellaceae
aaggcccgggaacgtattcaccgcggcatgctgatccgcgattactagcgattccaacttcatgcactcgagttgcagagtgcaatccgaactgagatggcttttggagattacgctcacactcgcgtgctcgctgcccactgtcaccaccattgtagcacgtgtgtagcccagcccgtaagggccattgaggcttgacgtcatccccacttcctctcgc

SEQ ID NO: 178 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Bradyrhizobiaceae
aaggcccgggaacgtattcaccgtggcatgctgatccacgattactagcgattccaacttcatgggctcgagttgcagagcccaatccgaactgagacggctttttgagtatttgcgaagggttgcccccttagcgtcccattgtcaccgccattgtagcacgtgtgtagcccagcccgtaagggccatgaggacttgacgtcatccccaccttctcgcg

SEQ ID NO: 179 - DNA, 220 bp, Unknown
  Description of Unknown: 16S RNA Operational Taxonomic Unit polynucleotide
  Phylum: Proteobacteria; Class: Deltaproteobacteria; Order: Syntrophobacterales; Family: Syntrophobacteraceae
aaggcccggaacgtatcgaccgcgggcgtgctgatccgcgattactagcgattccaacttcatggagtcgagttgcagactccaatccgaactgagagcggctttttgggattagctccccctcgcgggtttgcaaccctttgtaccgcccattgtagcacgtgtgtggccctggacataagggccatgatgacttgacgtcgtccccaccttcctccgg

SEQ ID NO: 180 - DNA, 220 bp, Unknown
  Description of Unknown: 16S RNA Operational Taxonomic Unit polynucleotide
  Phylum: Proteobacteria; Class: Betaproteobacteria
aagacccgggaacgtattcaccgcgacatgctgatccgcgattactagcgattccgacttcatgcagtcgagttgcagactgcaatccggactacgacgcgctttaagggattggctccacctcgcggcttggcaaccctctgtaccggccattgtatgacgtgtgaagccctaccataagggccatgaggacttgacgtcatccccaccttcctccggt

SEQ ID NO: 181 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Burkholderiaceae
aagacccgggaacgtattcaccgcggcatgctgatccgcgattactagcgattccagcttcacgcagtcgagttgcagactgcgatccggactacgatcggttttctgggattggctccacctcgcggcttagcgaccctctgttccgaccattgtatgacgtgtgaagccctacccataagggccatgaggacttgactcatccccaccttcctccggt

SEQ ID NO: 182 - DNA, 220 bp, Unknown
  Description of Unknown: 16S RNA Operational Taxonomic Unit polynucleotide
  Phylum: Proteobacteria; Class: Gammaproteobacteria; Order: Enterobacteriales; Family: Enterobacteriaceae
aaggcccgggacgtattcaccgtagcattctgatctacgattactagcgattccgacttcatggagtcgagttgcagactccaatccggactacgacgcactttatgaggtccgcttgctctcgcgagttcgcttctctttgtatgcgccattgtagcacgtgtgtagccctactcgtaagggccatgatgacttgacgtcatcccccttcctccagtta

SEQ ID NO: 183 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Phyllobacteriaceae
aaggcccgggaacgtattcaccgtggcatgctgatccacgattactagcgattccgacttcatgctctcgagttgcagagaacaatccgaactgagacggctttttgggaattaggctcctcctcgcggagtggctgcccactgtcaccgccattgtagcacgtgtgtagcccagcccgtaagggccatgatgacttgacgtcatccccaccttcctccg

SEQ ID NO: 184 - DNA, 220 bp, Unknown
  Description of Unknown: 16S RNA Operational Taxonomic Unit polynucleotide
  Phylum: Acidobacteria; Class: Acidobacteria; Order: Acidobacteriales
aggcccgggacgtattcaccgcggcgtgctgatccgcgattactagcgattccaacttcatgcaggcgagttgcagcctgcaatccgaactgagaccggctttctccgattagctccaccttgcggtatcgcgacggtttgtaccggccattgtagcacgtgtgtagccccagacataaaggccatgctgacttgacgtcatccccacttcctccggttt

SEQ ID NO: 185 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
agggtccgggaacgtattcaccgtagcgttgctgatctacgattactagcgattccagcttcatggagtcgagttgcagactccaatctgaactgagaagtggtttttggattagcttcatatcactatgttgcagccctttgtccactccattgtagcacgtgtgtagccctgggcataaaggccatgatgacttgacatcatcccctcttcctcacgt

SEQ ID NO: 186 - DNA, 220 bp, Unknown
  Description of Unknown: 16S RNA Operational Taxonomic Unit polynucleotide
  Phylum: Acidobacteria; Family: Koribacteraceae
aaggcccgggaacgtattcaccgcggcgtgctgatccgcgattactagcgattccagcttcatggagtcgagttgcagactccaatccgaactgaggccggctttttccgattagctccccttcgcaggtttgcgacggtttgtaccgaccattgtagcacgtgtgtagccctggacataaaggccatgaggacttgacgtcatcccaccttcctcccta

SEQ ID NO: 187 - DNA, 220 bp, Unknown
  Description of Unknown: 16S RNA Operational Taxonomic Unit polynucleotide
  Phylum: Proteobacteria; Class: Betaproteobacteria
aagaccagggaacgtattcaccgcgacatgctgatccgcgattactagcgattccgacttcatgcagtcgagttgcagactgcaatccggactacgaccggcttttatggggattggctccagctcgcgctttggcaaccctctgtaccggccattgtatgacgtgtgaagccctacccataagggccatgaggacttgacgtcatccccaccttcctcc

SEQ ID NO: 188 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Phyllobacteriaceae
agggcccgggaacgtattcaccgcggcacgctgatccgcgattactagcgattccgacttcatgctctcgagttgcagagaacaatccgaactgagacggctttttggttagcgcctcctcgcggagtggctgcccattgtcaccgccattgtagcacgtgtgtagcccagcccgtaagggccatgatgacttgacgtcatccccaccttcctccggctt

SEQ ID NO: 189 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Frankiaceae
aaggcccgggaacgtattcaccgcagcgttgctgatctgcgattactagcgactccgacttcatggggtcgagttgcagaccccaatccgaactgagaccggctttattgagattcgctccaccttgcggtatcgcagctctttgtaccggccattgtagcatgtgtgcagccctggacataaggggcgatgatgacttgacgtcatccccaccttcctc

SEQ ID NO: 190 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Mycobacteriaceae
aaggcccgggaacgtattcaccgcagcgttgctgatctgcgattactagcgactccgacttcacggggtcgagttgcagaccccgatccgaactgagaccggctttgaaaggattcgctccacctcaggcatcgcagccctttgtaccggccattgtagcatgtgtgaagccctggacataaggggcatgatgacttgacgtcatccctccttcctcacg

SEQ ID NO: 191 - DNA, 220 bp, Unknown
  Description of Unknown: 16S RNA Operational Taxonomic Unit polynucleotide
  Phylum: Firmicutes; Class: Bacilli; Order: Bacillales; Family: Bacillaceae
aaagacccgggaacgtattcaccgtggcatgctgatccacgattactagcgattccagcttcatgtaggcgagttgcagcctacaatccgaactgagaatggtttatgggattggctcgacctcgcggttttgcagccctttgtaccatccattgtagcacgtgtgtagcccaggtcataaggggcatgatgatttgacgtcatccccaccttcctccgg

SEQ ID NO: 192 - DNA, 220 bp, Unknown
  Description of Unknown: 16S RNA Operational Taxonomic Unit polynucleotide
  Phylum: Acidobacteria; Class: Chloracidobacteria
aagacccgggaacgtattcaccgcagcatgctgatctgcgattactagcgattccagcttcatggagtcgagttgcagactccaatccgaactgagacaagctttttgcgattggctcccccttgcaggtttgcagcgctttgtacttgccattgtagcacgtgtgtagccctggacattaaaggccatgacggactttgacgtcatccccaccttcctc

SEQ ID NO: 193 - DNA, 220 bp, Unknown
  Description of Unknown: 16S RNA Operational Taxonomic Unit polynucleotide
  Phylum: Proteobacteria; Class: Gammaproteobacteria; Order: Xanthomonadales; Family: Xanthomonadaceae
aaggcccggacgtattcaccgcagcaatgctgatctgcgattactagcgattccgacttcatggagtcgagttgcagactccaatccggactgagagaaggttctgggattggctcaccctcgcgggattgcagccctctgtccttcccattgtagtacgtgtgtagccctggccgtaagggccatgatgacttgacgtcatccccacttcctccggttt

SEQ ID NO: 194 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatgaagtcgagttgcagacttcaatctgaactgagaagtgttttttgagattggcttcacgtcaccgtgttgctgctctttgtacactccattgtagcacgtgtgtagccctgggcataaaggccatgatgacttgacatcatcccccttcctcacgt

SEQ ID NO: 195 - DNA, 220 bp, Unknown
  Description of Unknown: 16S RNA Operational Taxonomic Unit polynucleotide
  Phylum: Proteobacteria; Class: Alphaproteobacteria; Order: Sphingomonadales
aaggcctgggaacgtattcaccgtggcatgctgatccacgattactagcgattccgccttcatgctctcgagttgcagagaacaatccgaactgagacggcttttggggatttgctcactctcgcgagtttgcagcccactgtcaccgccattgtagcacgtgtgtagcccagcgcgtaagggccatgaggacttgacgtcatccccactcctccggctt

SEQ ID NO: 196 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Hyphomicrobiaceae
aaggcccgggaacgtattcaccgcagcgtgctgatctgcgattactagcgattccaacttcatggggtcgagttgcagaccccaatccgaactgagacggatttttgagatttgcgaagggtcgcccctttgcatccctctgtcaccgccattgtagcacgtgtgtagcccaccccgtaagggccatgaggacttgacgtcatccccacttctccgatta

SEQ ID NO: 197 - DNA, 220 bp, Unknown
  Description of Unknown: 16S RNA Operational Taxonomic Unit polynucleotide
  Phylum: Acidobacteria; Class: Acidobacteria; Order: Acidobacteriales
aaggcccgggaacgtattcaccgcggcgtgctgatccgcgattactagcgattccaacttcatgcaggcgagttgcagcctacaatccgaactgagacaggctttctccgattagctccaccttgcggtctcgcgacggtttgtacctgccattgtagcacgtgtgtggccccagacataaggccatgatgacttgacatcatcccctccttcctcacgt

SEQ ID NO: 198 - DNA, 220 bp, Unknown
  Description of Unknown: 16S RNA Operational Taxonomic Unit polynucleotide
  Phylum: Cyanobacteria; Class: Nostocophycideae; Order: Nostocales; Family: Nostocaceae
aaggcccgggaacgaattcactgcagtatgctgacctgcaattactagcgattcctccttcacgcaggcgagttgcagcctgcgatctgaactcgagctccggtttaccgggatttggcttgcattcgcatgcttgctgccctctgtccggagcattgtagtacgtgtgtagcccaaggcgtaaggggcatgctgacttgacgtcatccccaccttcctc

SEQ ID NO: 199 - DNA, 220 bp, Unknown
  Description of Unknown: 16S RNA Operational Taxonomic Unit polynucleotide
  Phylum: Acidobacteria; Class: Chloracidobacteria
acaagacccgggaacgtattcaccgcagcatgctgatctgcgattactagcgattccagcttcatggagtcgagttgcagactccaatccgaactgagacaagcttttgcgattggctcccctttgcaggtttgcagcgctttgtacttgccattgtagcacgtgtgtagccctggacataaaggccatgaggacttgacgtcatccccaccttcctccg

SEQ ID NO: 200 - DNA, 220 bp, Unknown
  Description of Unknown: 16S RNA Operational Taxonomic Unit polynucleotide
  Phylum: Proteobacteria; Class: Betaproteobacteria
aaggcctgggaacgtattcaccgcgacatgctgatccgcgattactagcgattccgacttcatgcagtcgagttgcagactgcaatccggactacgacgcgctttaagggattggctctacctcgcggcttagcaggccctctgtacgcgccattgtattacgtgtgaagccctacccataagggccatgaggacttgacgtcatccccaccttcctccg

SEQ ID NO: 201 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccggaacggtattcaccgtatcattgctgatatacgattactagcgattccagcttcatggagtcgagttgcagactccaatctgaactgagaggcgttttttgggtattggctccttatcgctaagtggcagcccttttgtacgccccattgtagcacgtgtgtagccctgggcataaaggccatgatgacttgacatcatcccctccttcctc

SEQ ID NO: 202 - DNA, 220 bp, Unknown
  Description of Unknown: 16S RNA Operational Taxonomic Unit polynucleotide
  Phylum: Proteobacteria; Class: Alphaproteobacteria
aaaggcccgggaacgtattcaccgcagcctgctgttctgcgattactagcgattccaccttcatgtactcgagttgcagagtacaatctgaactgggacggttttttgggattagccgcttctcgcgaagtagctgcccactgtcaccgccattgtagcacgtgtgtagcccagggtgtaagggccatgaggacttgacgtcatccccacttcctccggc

SEQ ID NO: 203 - DNA, 220 bp, Unknown
  Description of Unknown: 16S RNA Operational Taxonomic Unit polynucleotide
  Phylum: Proteobacteria; Class: Alphaproteobacteria; Order: Sphingomonadales; Family: Sphingomonadaceae
aaggcctgggaacgtattcaccgcggcatgctgatccgcgattactagcgattccgccttcatgctctcgagttgcagagaacaatccgaactgagacggtttttgggagtttgctcactctcgcgagtttgctgcccactgtcaccgccattgtagcacgtgtgtagcccagcgcgtaagggccatgaggacttgacgtcatccccaccttccccggcg

SEQ ID NO: 204 - DNA, 220 bp, Unknown
  Description of Unknown: 16S RNA Operational Taxonomic Unit polynucleotide
  Phylum: Proteobacteria; Class: Betaproteobacteria
aagacccgggaacgtattcaccgcggcatgctgatccgcgattactagcgattccgacttcatgcagtcgagttgcagactgcaatccggactacgaccggctttctgggattggcctccccctcgcgggttggcaaccctctgtaccggccattgtatgacgtgtgaagccctacccataagggccatgaggacttgacgtcatccccactctccggtt

SEQ ID NO: 205 - DNA, 220 bp, Unknown
  Description of Unknown: 16S RNA Operational Taxonomic Unit polynucleotide
  Phylum: Verrucomicrobia; Class: Spartobacteria; Order: Spartobacteriales; Family: Spartobacteriaceae
acaaggcccgggaacgtattcacggcgtcgtagctgatacgccattactagcgattccggcttcatgaagtcgagttgcagacttcaatctgaactgggcccagttttagagatttcctccacctcgcggtcttggatcgttctgtgctgggcattgtagtacgtgtgcagcccaggccgtaagggccatactgacttgacgtcgtccccaccttcctcc

SEQ ID NO: 206 - DNA, 220 bp, Unknown
  Description of Unknown: 16S RNA Operational Taxonomic Unit polynucleotide
  Phylum: Acidobacteria; Class: Chloracidobacteria
acaagacccgggaacgtattcaccgcaacattctgatttgcgattactagcgattccaacttcatggagtcgagttgcagactccaatccgaactgagatcggtttttgcgattggctccccctcgcgggattgcgacgctttgtaccgaccattgtagcacgtgtgtagccctgaacataaaggccatgatgacttgacatcatccccaccttcctccg

SEQ ID NO: 207 - DNA, 220 bp, Unknown
  Description of Unknown: 16S RNA Operational Taxonomic Unit polynucleotide
  Phylum: Firmicutes; Class: Bacilli; Order: Bacillales; Family: Bacillaceae
acggcccgggaacgtattcaccgcggcatgctgatccgcgattactagcgattccagcttcatgtaggcgagttgcagcctacaatccgaactgagaacggttttatgagattagctccacctcgcggtcttgcaactctttgtaccgtccattgtagcacgtgtgtagcccaggtcataaggggcatgatgatttgacgtcatccccaccttcctccgg

SEQ ID NO: 208 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaaggtccgggaacgtattcaccgtagcattgctgatctacgattactagcgattccagcttcatggggtcgagttgcagaccccaatctgaactgagacgaggtttttgagattagcatccagttacctggtagcagccctttgtcctcccattgtagcacgtgtgtagccctgggcataaaggccatgatgacttgacatcatcccctcttcctcacg

SEQ ID NO: 209 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Burkholderiaceae
aagacccgggaacgtattcaccgcggcatgctgatccgcgattactagcgattccagcttcacgtagtcgagttgcagactacgatccggactacgatgcgttttctgggattggctcccccctcgccgggttggcaaccctctgtacgcaccattgtatgacgtgtgaagccctacccataagggccatgaggacttgacgtcatccccaccttcctcc

SEQ ID NO: 210 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatgcagtcgagttgcagactgcaatctgaactgagagtgctttttgggattagctccttgtcaccaagtggcagccctttgtagcacccattgtagcacgtgtgtagccctgggcataaaggccatgatgacttgacatcatcccctccttcctcgcg

SEQ ID NO: 211 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatgaagtcgagttgcagacttcaatctgaactgagagacgttttttgggattagcttcacgtcaccgtgttgctgccctttgtacgtcccattgtagcacgtgtgtagccctggcataaaggccatgatgacttgacatcatcccctccttcctcgcg

SEQ ID NO: 212 - DNA, 220 bp, Unknown
  Description of Unknown: 16S RNA Operational Taxonomic Unit polynucleotide
  Phylum: Acidobacteria; Class: Chloracidobacteria
aagacccgggaacgtattcaccgcggcgttctgatccgcgattactagcgattccaacttcatgaagtcgagttgcagacttcaatccgaactgagaccggtttttgcgattagcctccccctttacgggattgcgacgttttgtaccggccattgtagcacgtgtgtagccctaagcataaaggccatgatgacttgacatcatccccaccttcctccg

SEQ ID NO: 213 - DNA, 220 bp, Unknown
  Description of Unknown: 16S RNA Operational Taxonomic Unit polynucleotide
  Phylum: Proteobacteria; Class: Betaproteobacteria; Order: Rhodocyclales
aagacccgggaacgtattcaccgcgacattgctgatccgcgattactagcgattccgacttcatgcagtcgagttgcagactgcaatccggactacgacgcactttctgggattggctccccctcgcgggttggcagccctctgtatgcgccattgtatgacgtgtgaagccctacccataagggccatgaggacttgacgtatccacctctccgtccgt

SEQ ID NO: 214 - DNA, 220 bp, Unknown
  Description of Unknown: 16S RNA Operational Taxonomic Unit polynucleotide
  Phylum: Proteobacteria; Class: Betaproteobacteria
atgacccgggaacgtattcaccgcgacatgctgatccgcgattactagcgattccgacttcatgcagtcgagttgcagactgcaatccggactacgaccggctttctgggattggctccgcctcgcggcttggcaaccctctgtaccggccattgtatgacgtgtgaagccctacccataagggccatgaggacttgacgtcatccccacttcctccggt

SEQ ID NO: 215 - DNA, 220 bp, Unknown
  Description of Unknown: 16S RNA Operational Taxonomic Unit polynucleotide
  Phylum: Proteobacteria; Class: Alphaproteobacteria; Order: Sphingomonadales; Family: Sphingomonadaceae
aaggcctgggaacgtattcaccgcggcgtgctgatccgcgattactagcgattccgccttcatgctctcgagttgcagagaacaatccgaactgagacggctttttgggattgctcaccctcgcgagtttgctgcccattgtcaccgccattgtagcacgtgtgtagcccagcgcgtaagggccatgaggacttgacgtcattccccaccttcctccggg

SEQ ID NO: 216 - DNA, 220 bp, Unknown
  Description of Unknown: 16S RNA Operational Taxonomic Unit polynucleotide
  Phylum: Gemmatimonadetes; Class: Gemmatimonadetes; Order: Gemmatimonadales; Family: Gemmatimonadaceae
aaggcccgggaacgtattcaccgtggcgtagctgatccacgattactagcgattccagcttcatgccctcgggttgcagaggacaatccgaactgaggacgggtttgtcgggattggctccgggtttccccctcgcgaccctctgtcccgtccattgtagcacgtgtgtagccctggacgtaaggacccatgataggacttgacgtcgtccccaccttcc

SEQ ID NO: 217 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Intrasporangiaceae
aaggcccgggaacgtattcaccgcagcgttgctgatctgcgattactagcgacttccgacttcatggggtcgagttgcagaccccaatccgaactgagaccggttttttgggatttcgctccacctcgcggtttcgcagccctttgtaccggccattgtagcatgcgtgaagcccaagacataaggggcatgatgatttgacgtcatcccccaccttcct

SEQ ID NO: 218 - DNA, 220 bp, Unknown
  Description of Unknown: 16S RNA Operational Taxonomic Unit polynucleotide
  Phylum: Acidobacteria; Class: Chloracidobacteria
aagacccgggaacgtattcaccgcagcgtgctgatctgcgattactagcgattccagcttcatggagtcgagttgcagactccaatccgaactgagacaagctttttgcgattggctccctctcgcgagtttgcagcgctttgtacttgccattgtagcacgtgtgtagccctggacataaaggccatgagggactttgacgtcatccccaccttcctcc

SEQ ID NO: 219 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatggagtcgagttgcagactccaatctgaactgagaggcgttttttgggattagcttcatatcgctatgttgcagccctttgtacgccccattgtagcacgtgtgtagccctgggcataaaggccatgatgactgacatcaatcccctcttcctcacg

SEQ ID NO: 220 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
acaaggtccgggaacgtattcaccgtagcgttgctgatctacgattactagcgattccagcttcatgcaggcgagttgcagcctgcaatctgaactgagagaaggtttttgagattggcgccctgtcaccaggtggcagctctttgtccttcccattgtagcacgtgtgtagccctgggcataaaggccatgatgacttgacatcatcccctccttcctc

SEQ ID NO: 221 - DNA, 220 bp, Unknown
  Description of Unknown: 16S RNA Operational Taxonomic Unit polynucleotide
  Phylum: Acidobacteria; Class: Acidobacteria; Order: Acidobacteriales
aaggcccgggaacgtattcaccgcggcgtgctgatccgcgattactagcgattccaacttcaagcaggcgagttgcagcctgctatccgaactgagaccggctttctccgattagctcccccttgcgggctcgcgacggtttgtaccggccattgtagcacgtgtgtagccccagacataaaggccatgctgacttgacgtcatccccaccttcctcccc

SEQ ID NO: 222 - DNA, 220 bp, Unknown
  Description of Unknown: 16S RNA Operational Taxonomic Unit polynucleotide
  Phylum: Proteobacteria; Class: Betaproteobacteria
aagacccgggaacgtattcaccgcgacatgctgatccgcgattactagcgattccgacttcatgcagtcgagttgcagactgcaatccggactacgaccggctttctgggattggctccagctcgcgctttggcaaccctctgtaccggccattgtatgacgtgtgaagcctacccaataagggccatgaggacttgacgtcatcccaccttcctccggt

SEQ ID NO: 223 - DNA, 220 bp, Unknown
  Description of Unknown: 16S RNA Operational Taxonomic Unit polynucleotide
  Phylum: Proteobacteria; Class: Gammaproteobacteria; Order: Chromatiales; Family: Sinobacteraceae
aaagacccgggaacgtattcaccgtgacatcgctgattcacgattactagcgattccgacttcacgcagccgagttgcagactgcgatccggactacgaccggctttttgggattggctccccctcgcgggttggcaaccctttgtaccggccattgtagcacgtgtgtagccctggtcataagggccatgatgacttgacgtcatccccacttcctccg

SEQ ID NO: 224 - DNA, 220 bp, Unknown
  Description of Unknown: 16S RNA Operational Taxonomic Unit polynucleotide
  Phylum: Acidobacteria; Family: Koribacteraceae
aaggcccgggaacgtattcaccgcagcgtgctgatctgcgattactagcgattccagcttcatggagtcgagttgcagactccaatccgaactgaggccggctttttccgattagctccccctcgcgggtttgcgacagtttgtaccgaccattgtagcacgtgtgtggccctggacataaaggccatgaggacttgacgtcatcccccaccttcctcca

SEQ ID NO: 225 - DNA, 220 bp, Unknown
  Description of Unknown: 16S RNA Operational Taxonomic Unit polynucleotide
  Phylum: Actinobacteria; Class: Actinobacteria; Order: Actinomycetales
aaggcccgggaacgtattcaccgcagcgttgctgatctgcgattactagcgactccgacttcatggggtcgagttgcagaccccaatccgaactgagaccggctttttgggattcgctccaccttacagtttcgcagccctttgtaccggccattgtagcatgcgtgaagccctggaccataagggcatgatgacttgacgtcatccccacttcctccga

SEQ ID NO: 226 - DNA, 220 bp, Unknown
  Description of Unknown: 16S RNA Operational Taxonomic Unit polynucleotide
  Phylum: Firmicutes; Class: Bacilli; Order: Bacillales
aaggcccgggaacgtattcaccgcggcatgctgatccgcgattactagcgattccagcttcatgtaggcgagttgcagcctacaatccgaactgtagaatggtttatgggattggcttgacctcgcggtcttgcagcccttgtaccatccattgtagcacgtgtgtagcccaggtcataaggggcatgatgactttgaccgtcatccccaccttcctccg

SEQ ID NO: 227 - DNA, 220 bp, Unknown
  Description of Unknown: 16S RNA Operational Taxonomic Unit polynucleotide
  Phylum: Acidobacteria; Family: Koribacteraceae
aaggcccgggaacgtattcaccgcagcgttctgatctgcgattactagcgattccagcttcatggagtcgagttgcagactccaatccgaactgaggtcggctttttccgattagctccccctcgcgggtttgtcgacggtttgtaccgaccattgtagcacgtgtgtagccctggacataaaggccatgagggacttgacgtcatcccccacccttcct

SEQ ID NO: 228 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatggagtcgagttgcagactccaatctgaactgagagacgtttttgagattggcttcacatcgctgtgttgctgctctttgtacgtcccattgtagcacgtgtgtagccctgggcataagggccatgatgacttgacgtcatccccaccttcctccgg

SEQ ID NO: 229 - DNA, 220 bp, Unknown
  Description of Unknown: 16S RNA Operational Taxonomic Unit polynucleotide
  Phylum: Proteobacteria; Class: Betaproteobacteria
aagaccggaacgtattcaccgcgacatgctgatccgcgattactagcgattccgacttcatgcagtcgagttgcagactgcaatccggactacgaccggcttttatggggattggctccgcctcgcggcttggcaaccctctgtaccggccattgtatgacgtgtgaagccctaccataagggccatgaggacttgacgtcatccccaccttctccggtt

SEQ ID NO: 230 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Comamonadaceae
aagacccgggaacgtattcaccgcgacattctgatccgcgattactagcgattccgacttcacgtagtcgagttgcagactacgatccggactacgactggttttatgggattagctcccctcgcgggttggcaacctctgtaccagccattgtatgacgtgtgtagccctacctataagggccatgaggacttgacgtcatccccaccttctccggttt

SEQ ID NO: 231 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aaggcccgggaacgtattcgaccgcagcaatgctgatctgcgattactagcaactccgacttcatgggggtcgattgcagaccccaatccgaactgagacaggcttttttgagattcgctccacctcacggtatcgcagctcattgtacctgccattgtagcacgtgtgcagcccaagacataaggggcatgatgacttgacgtcgtccccaccttcctc

SEQ ID NO: 232 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Oxalobacteraceae
aagacccgggaacgtattcaccgcgacatgctgatccgcgattactagcgattccaacttcacgcagtcgagttgcagactgcgatccggactacgatactactttctgggattagcctccccctcgcgggttggcggccctctgtatgtaccattgtatgacgtgtgaagccctacccataagggccatgaggacttgacgtccatcccccaccttcct

SEQ ID NO: 233 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatggagtcgagttgcagactccaatctgaactgagaggcgtttttgggattagcttcatatcgctatgttggcagcccctttgtacgccccattgtagcacgtgtgtagccctgggcataaaggccatgatgacttgacatcatcccctccttcctca

SEQ ID NO: 234 - DNA, 220 bp, Unknown
  Description of Unknown: 16S RNA Operational Taxonomic Unit polynucleotide
  Phylum: Verrucomicrobia; Class: Opitutae; Order: Opitutales; Family: Opitutaceae
aaggcccggaacgtattcacggcgccgtagctgatgcgccattactagcgattccaacttcatgtagtcgagttgcagactacaatctgaactgggcccggttttgaggattgctccacctcgcggtattgcttccctctgtaccgggcattgtagtacgtgtgcagccctggccgtaagggccatcctgacttgacgtcatccccaccttcccaccctc

SEQ ID NO: 235 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
agggtccgggaacgtattcaccgtatcattgctgatatacgattactagcgattccagcttcatgcaggcgagttgcagcctgcaatctgaactgagaagagtttttgggattggctccttgtcaccaagtggcagccctttgtactctccattgtagcacgtgtgtagccctgggcataaaggccatgatgacttgacatcatcccctccttcctcgcg

SEQ ID NO: 236 - DNA, 220 bp, Unknown
  Description of Unknown: 16S RNA Operational Taxonomic Unit polynucleotide
  Phylum: Acidobacteria; Class: Chloracidobacteria
aagacccgggaacgtattcaccgcaacatgctgatttgcgattactagcgattccaacttcatgaagtcgagttgcagacttcaatccgaactgagaccggttttagcgattggctccccttgcgggattgcgacgtttgtaccggccattgtagcacgtgtgtagccctgaacataaaggccatgatgacttgacatcatccccactcctccgtttatc

SEQ ID NO: 237 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Pseudonocardiaceae
aagcccgggaacgtattcaccgcagcgttgctgatctgcgattactagcgactccaacttcacggggtcgagttgcagaccccgatccgaactgagacccactttaagggattcgctccacctcacggtctcgcagccctctgtataggccattgtagcatgtgtgaagccctggacataaggggcatgatgacttgacgtcatccccaccttcctccga

SEQ ID NO: 238 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Nocardioidaceae
aaggcccggaacgtattcaccgcagcgttgctgatctgcgattactagcgactccgacttcatggggtcgagttgcagaccccaatccgaactgagaccggctttttgggatcgctccgccttacagcatcgcagccctttgtaccggccattgtagcatgcgtgaagccctggacataaggggcatgatgacttgacgtcatccccaccttcctccgag

SEQ ID NO: 239 - DNA, 220 bp, Unknown
  Description of Unknown: 16S RNA Operational Taxonomic Unit polynucleotide
  Phylum: Gemmatimonadetes; Class: Gemmatimonadetes; Order: Gemmatimonadales; Family: Gemmatimonadaceae
aaggcccgggaacgtattcaccgtggcgtagctgatccacgattactagcgattccagcttcatgccgtcgggttgcagacgacaatccgaactgaggcggggtttacggggattggtcttgccgttgccggctcgcagccctttgtccccgccattgtagcacgtgtgtagccctagacgtaaggaccatgatgacttgacgtcgtccccaccttcctc

SEQ ID NO: 240 - DNA, 220 bp, Unknown
  Description of Unknown: 16S RNA Operational Taxonomic Unit polynucleotide
  Phylum: Proteobacteria; Class: Alphaproteobacteria; Order: Rhizobiales
aaggcccgggaacgtattcaccgtggcgtgctgatccacgattactagcgattccaacttcatgcactcgagttgcagagtgcaatccgaactgagacggcttttagggatagcatgtctcgcggactagctgccctctgtcaccgccattgtagcacgtgtgtagccagcccgtaagggccatgaagacttgacgtcatccccaccttcctccggctta

SEQ ID NO: 241 - DNA, 220 bp, Unknown
  Description of Unknown: 16S RNA Operational Taxonomic Unit polynucleotide
  Phylum: Actinobacteria; Class: Actinobacteria; Order: Actinomycetales
aaggcccgggaacgtattcaccgcgacgttgctgattcgcgattactagcgactccgacttcatggggtcgagttgcagaccccaatccgaactgagaccagcttttttgggtagttcgctccaccttgcggtctcgcaaccctttgtactggccattgtagcatgtttgcagcccaagacataaggggcgatgaggacttgacgtcatccccaccttcc

SEQ ID NO: 242 - DNA, 220 bp, Unknown
  Description of Unknown: 16S RNA Operational Taxonomic Unit polynucleotide
  Phylum: Proteobacteria; Class: Betaproteobacteria
aagacccgggaacgtattcaccgcggcatgctgatccgcgattactagcgattccgacttcatgcagtcgagttgcagactgcaatccggactacgaccggctttctgggattcggctcccccgtcgcgggttggcaaccctctgtaccggccattgtatgacgtgtgaagccctaccataagggccatgaggacttgacgtcatccccaccttcctccg

SEQ ID NO: 243 - DNA, 220 bp, Unknown
  Description of Unknown: 16S RNA Operational Taxonomic Unit polynucleotide
  Phylum: Acidobacteria; Class: Chloracidobacteria
aagaccccgggaacgtattcaccgcagcattctgatctgcgattactagcgattccaacttcatgaagtcgagttgcagacttcaatccgaactgagaccggtttttgcgattagctcccctcttacgagattgcgacgttttgtaccggccattgtagcacgtgtgtagccctaagcataaaggccatgatgacttgacatcatccccaccctccgttt

SEQ ID NO: 244 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggcccgggaacgtattcaccgtatcattgctgatatacgattactagcgattccagcttcatggggtcgagttgcagaccccaattcgaactgagacgagttttttgagattagcatcctgttaccaggtagctgccctttgtactcgccattgtagcacgtgtgtagccctgggcataaaggccatgatgacttgacatcatcccctccttcccccg

SEQ ID NO: 245 - DNA, 220 bp, Unknown
  Description of Unknown: 16S RNA Operational Taxonomic Unit polynucleotide
  Phylum: Proteobacteria; Class: Alphaproteobacteria; Order: Sphingomonadales; Family: Sphingomonadaceae
aaggcctgggaacgtattcaccgcggcatgctgatccgcgattactagcgattccgccttcatgcactcgagttgcagagtgcaatccgaactgagacaacttttggagattagctcaccctcgcgggattgctgcccactgtagttgccattgtagcacgtgtgtagcccataagggccatgaggacttgacgtcatccccaccttcctccggcttgtc

SEQ ID NO: 246 - DNA, 220 bp, Unknown
  Description of Unknown: 16S RNA Operational Taxonomic Unit polynucleotide
  Phylum: Chloroflexi; Class: Anaerolineae; Order: envOPS12
gaggcccgagaacgtattcaacgcactatagctgacgcgcgtttactagcaactccggcttcatgcaggcgagttgcagcctgcaatctgaactgaggacagttttgggggattggctccacctcgcggcttagcaacccattgtactgcccattgtagcgtgtgtgtagccccaggcataaaggccatgctgacttgacgtcatccccaccttcctccg

SEQ ID NO: 247 - DNA, 220 bp, Unknown
  Description of Unknown: 16S RNA Operational Taxonomic Unit polynucleotide
  Phylum: Actinobacteria; Class: Actinobacteria; Order: MC47
aaggcccgagaacgcattcaccgcggcgttgctgatccgcgattactagcaactccgccttcatggaggcgagtttcagcctccaatccgaaccgggaccggcttttttgggatttcgctccccctcacgggtttgcagccctctgtaccggccaatgtagcacgtgtgtagcccgagacgtaaggggcatgatgacttgacatcatccccacttcctcc

SEQ ID NO: 248 - DNA, 220 bp, Unknown
  Description of Unknown: 16S RNA Operational Taxonomic Unit polynucleotide
  Phylum: Acidobacteria; Class: Chloracidobacteria
aagacccgggaacgtattcaccgcagcgttctgatctgcgattactagcgattccaacttcatgaagtcgagttgcagacttcaatccgaactgagaatggttttcgcgattagctccctcttacgagattgcgacgttttgtaccatccattgtagcacgtgtgtagccctaagcataaaggccatgatgacttgacatcatccccactctccgtttat

SEQ ID NO: 249 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Pseudonocardiaceae
aaggcccgggaacgtattcaccgcagcattgctgatctgcgattactagcgactccgacttcacggggtcgagttgcagaccccgatccgaactgagacccactttaagggattcgctccacctcacggtctcgcagccccttctgtatgagcccattgtagcatgtgtgaagccctggacataaggggcatgatgacttgacgtcatccccacttcctc

SEQ ID NO: 250 - DNA, 220 bp, Unknown
  Description of Unknown: 16S RNA Operational Taxonomic Unit polynucleotide
  Phylum: Acidobacteria; Class: Chloracidobacteria
aagactcgggaacgtattcaccgcagcatgctgatctgcgattactagcgattccagcttcatggagtcgagttgcagactccaatccgaactgagacaagctttttccgattggctccccattgctggtttgcagcggtttgtacctgccattgtagcacgtgtgtagccctggacataaaggccatgaggacttgacgtcatccccaccttcctccgt

SEQ ID NO: 251 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Mycobacteriaceae
aaggcccgggaacgtattcaccgcagcgttgctgatctgcgattactagcgactccgacttcacggggtcgagttgcagaccccgatccgaactgagaccggctttaaaaggattcgtctccacctcacggcatcgcagccctttgtaccggccattgtagcatgtgtgaagccctggaccataaggggcatgatgacttgacgtcatcccacctcctcc

SEQ ID NO: 252 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcacgcagtcgagttgcagactgcgatctgaactgagaagaggttttgtagattagctccttgtcaccaagtggcagctctttgtcctctccattgtagcacgtgtgtagccctgggcataaaggccatgatgaccttgacatcatccccctcctcctca

SEQ ID NO: 253 - DNA, 220 bp, Unknown
  Description of Unknown: 16S RNA Operational Taxonomic Unit polynucleotide
  Phylum: Verrucomicrobia; Class: Spartobacteria; Order: Spartobacteriales; Family: Spartobacteriaceae
aaggcccgggaacgtattcacgccgtcgtagctgatacggcattactagcgattccggcttcatggaggcgagttgcagcctccaatccgaactgagctcagttttactggattcctccacctcgcggtctcggatcgttctgtactgagcattgtagtacgtgtgcagcccaggccgtaagggccatactgacttgacgtcgtcccaccttcctccctt

SEQ ID NO: 254 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatggagtcgagttgcagactccaatctgaactgagagcaggtttttgggattggcttcatatcactatgttgcagccctttgtcctgcccattgtagcacgtgtgtagccctgggcataaaggccatgatgacttgacatcatcccttcctcacgcct

SEQ ID NO: 255 - DNA, 220 bp, Unknown
  Description of Unknown: 16S RNA Operational Taxonomic Unit polynucleotide
  Phylum: Acidobacteria; Family: Koribacteraceae
aaggcccggaacgtatcgaccgcggcgttctgatccgcgattactagcgattccagcttcatggagtcgagttgcagactccaatccgaactgaggccggctttttccgattagctccccctcacgggtttgcgacggtttgtaccgaccattgtagcacgtgtgtagccctggacataaaggccatgaggacttgacgtcatccccaccttcctcctcg

SEQ ID NO: 256 - DNA, 220 bp, Unknown
  Description of Unknown: 16S RNA Operational Taxonomic Unit polynucleotide
  Phylum: Actinobacteria; Class: Actinobacteria; Order: Solirubrobacterales; Family: Solirubrobacteraceae
aaggcccgggaacgtattcaccgtggcagtgctgatccacgattactagcaactccaccttcatgcaggggtttcagcctgcaatccgaaccgagacgcgctttaagggattcgctccacctcgcggtatcgcagccctctgtacgcgccaatgtagcacgtgtgtagccctggacataaggggcatgatgacttgacgtcatccccaccttcctccggt

SEQ ID NO: 257 - DNA, 220 bp, Unknown
  Description of Unknown: 16S RNA Operational Taxonomic Unit polynucleotide
  Phylum: Acidobacteria; Class: Chloracidobacteria
aaggcccgggaacgtattcaccgcggcgttctgatccgcgattactagcgattccaacttcatgaagtcgagttgcagacttcaatccgaactgagaccggtttttgcgattagctccctcttgcgagattgcgacgttttgtaccggccattgtagcacgtgtgtagccctgaacataaaggccatgatgacttgacatcatccccaccttctccgttt

SEQ ID NO: 258 - DNA, 220 bp, Unknown
  Description of Unknown: 16S RNA Operational Taxonomic Unit polynucleotide
  Phylum: Proteobacteria; Class: Deltaproteobacteria; Order: Myxococcales; Family: Cystobacteraceae
aaggcccgggaacgtattcaccgcagcgtgctgatctgcgattactagcgattccgccttcatggagtcgagttgcagactccaatctgaactgagaccggttttatgccgatttggctccctctcgcgagttggcagcgctttgtaccggccattgtagcacgtgtgtagccctggtcataaaggccatgaggacttgacgtcatccccacttcctccg

SEQ ID NO: 259 - DNA, 220 bp, Unknown
  Description of Unknown: 16S RNA Operational Taxonomic Unit polynucleotide
  Phylum: Gemmatimonadetes; Class: Gemmatimonadetes; Order: Gemmatimonadales; Family: Gemmatimonadaceae
aaggcccgggaacgtattcaccgtggcgtagctgatccacgattactagcgattccagcttcatgccgtcgagttgcagacgacaatccgaactgaggcggggttaacggaattggcttgccgttgccggctcgcagccctctgtccctgccattgtagcacgtgtgtagccctagacgtaaggaccatgaggacttgacgtcatccccaccttcctccg

SEQ ID NO: 260 - DNA, 220 bp, Unknown
  Description of Unknown: 16S RNA Operational Taxonomic Unit polynucleotide
  Phylum: Gemmatimonadetes; Class: Gemmatimonadetes; Order: Gemmatimonadales; Family: Gemmatimonadaceae
aaggcccgggaacgtattcaccgtggcgtagctgatccacgattactagcgattccagcttcatgccgtcgagttgcagacgacaatccgaactgaggaccggttttgggattgcctaggcattgctgcctcggaccctctgtccggcccattgtagcacgtgtgtagccctagacgtaaggaccatgatgacttgacgtcgtccccaccttcctccggt

SEQ ID NO: 261 - DNA, 220 bp, Unknown
  Description of Unknown: 16S RNA Operational Taxonomic Unit polynucleotide
  Phylum: Actinobacteria; Class: Actinobacteria; Order: Actinomycetales
aaggcccgggaacgtattcaccgcagcgttgctgatctgcgattactagcgactccgacttcatggggtcgagttgcagaccccaatccgaactgagaccggctttttgggattcgctctaccttgcggtttcgctgccctttgtaccggccattgtagcatgtgtgcagccctggacataaggggcatgatgacttgacgtgtccccacttcctccgag

SEQ ID NO: 262 - DNA, 220 bp, Unknown
  Description of Unknown: 16S RNA Operational Taxonomic Unit polynucleotide
  Phylum: Gemmatimonadetes; Class: Gemmatimonadetes; Order: Gemmatimonadales; Family: Gemmatimonadaceae
aaggcccgggaacgtattcaccgtggcgatgctgatccacgattactagcgattccagcttcatgccgtcgagttgcagacgacaatccgaactgaggatcggttttgggattgccttggcattgctgcctcggcccccacctgtccgacccacttgttagcacgtgtgtagccctagacgtaaggaccatgatgacttgacgtcgtccccacccttcct

SEQ ID NO: 263 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
agggcccgggaacgtattcaccgcagcatgctgatctgcgattactagcaactccaacttcatggggtcgagttgcagaccccaatccgaactgagaccggctttttgggattcgctccgcctcgcggcatcgcagccctttgtaccggccattgtagcacgtgtgcagcccaagacataaggggcatgatgatttgacgtcgtccccaccttcctccga

SEQ ID NO: 264 - DNA, 220 bp, Unknown
  Description of Unknown: 16S RNA Operational Taxonomic Unit polynucleotide
  Phylum: Acidobacteria; Class: Acidobacteria; Order: Acidobacteriales
aaggcccgggaacgtattcaccgcggcgtgctgatccgcgattactagcgattccaacttcacgcaggcgagttgcagcctacgatccgaactgagaccgacttctccgatagctccaccttgcggtatcgcgacggttgtatcggccattgtagcacgtgtgtagccccagacataaaggccatgctgacttgacgtcatccccaccttcctccggttt

SEQ ID NO: 265 - DNA, 220 bp, Unknown
  Description of Unknown: 16S RNA Operational Taxonomic Unit polynucleotide
  Phylum: Acidobacteria; Class: Acidobacteria; Order: Acidobacteriales
aaggcccgggaacgtattcaccgcggcgtgctgatccgcgattactagcgattccaacttcatgccggcgagttgcagccgacaatccgaactgagacaggcttttctccgatagctccaccttgcggtctcgcgacggtttgtacctgccattgtagcacgtgtgtggccccagacataaaggccatgctgacttgacgtcatccccaccttcctccgg

SEQ ID NO: 266 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Oxalobacteraceae
gagacccgggaacgtattcaccgcgacatgctgatccgcgattactagcgattccaacttcatgtagtcgagttgcagactacaatccggactacgatacactttctgggattagctccccctcgcgggttggcggccctctgtatgtaccattgtatgacgtgtgaagccctacccataagggccatgaggacttgacgtcatccccaccttctccggt

SEQ ID NO: 267 - DNA, 220 bp, Unknown
  Description of Unknown: 16S RNA Operational Taxonomic Unit polynucleotide
  Phylum: Proteobacteria; Class: Betaproteobacteria; Order: Burkholderiales
aggacccgggaacgtattcaccgcgacattctgatccgcgattactagcgattccgacttcacgcagtcgagttgcagactgcgatccggactacgaccggttttctgggattggctccagctcgcgctttggcagccctctgtaccggccattgtatgacgtgtgtagccctaccataagggccatgaggacctgacgtcatccccaccttcctccggt

SEQ ID NO: 268 - DNA, 220 bp, Unknown
  Description of Unknown: 16S RNA Operational Taxonomic Unit polynucleotide
  Phylum: Verrucomicrobia; Class: Verrucomicrobiae; Order: Verrucomicrobiales; Family: Verrucomicrobia subdivision 3
aaggcctgggaacgtattcacggcgccgtagctgatgcgccattactagcgattccagcttcatgccgtcgagttgcagacgacaatctgaactggcccggtttttgggatttgctccatcttacgatcttgcttccctttgtgccgggcattgtagtacgtgtgcagccctggccgtaagggccatactgacttgacgtcatcccccaccttcctcctc

SEQ ID NO: 269 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Hyphomicrobiaceae
acaaggcccgggaacgtattcaccgcgccatgctgatgcgcgattactagcgattccgacttcatgaggtcgagttgcagacctcaatctgaactgagacggcttttgcgattagctccctattgctaggtggctgcgcattgtcaccgccattgtagcacgtgtgtagcccagcccgtaagggccatgatgacttgacgtcatccccaccttcctccgg

SEQ ID NO: 270 - DNA, 220 bp, Unknown
  Description of Unknown: 16S RNA Operational Taxonomic Unit polynucleotide
  Phylum: Proteobacteria; Class: Alphaproteobacteria; Order: Sphingomonadales; Family: Sphingomonadaceae
aaggcctgggaacgtattcaccgcggcatgctgatccgcgattactagcgattccgccttcatgctctcgagttgcagagaacaatccgaactgagacgggcttttggtagattagctcaccctcgcgggtttgcagccctctgtcaccgccattgtagcacgtgtgtagcccagcgcgtaagggccatgaggacttgacgtcatccccaccttcctccg

SEQ ID NO: 271 - DNA, 220 bp, Unknown
  Description of Unknown: 16S RNA Operational Taxonomic Unit polynucleotide
  Phylum: Acidobacteria; Class: Acidobacteria; Order: Acidobacteriales
aaggcccgggaacgtattcaccgcggcgtgctgatccgcgattactagcgattccaacttcaagcaggcgagttgcagcctgctatccgaactgagacagactttctccgattagctcaccttgcgtctcgcgacggtttgtatctgccattgtagcacgtgtgtagccccagacataaggccatgctgacttgacgtcatccccacttcctccggttta

SEQ ID NO: 272 - DNA, 220 bp, Unknown
  Description of Unknown: 16S RNA Operational Taxonomic Unit polynucleotide
  Phylum: Proteobacteria; Class: Betaproteobacteria; Order: Nitrosomonadales; Family: Nitrosomonadaceae
gagacccgggaacgtattcaccgcgacatgctgatccgcgattactagcgattccgacttcacggagtcgagttgcagactccgatccggactacgacgcgctttctgagattagctcccctcgcgggttggcaaccctctgtacgcgccattgtattacgtgtgaagccctacccataagggccatgaggacttgacgtcatccccaccttcctccggt

SEQ ID NO: 273 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtagcgttgctgatctacgattactagcgattccagcttcatgcaggcgagttgcagcctgcaatctgaactgagagaggtttttgagattagcgcctgtcaccaggtggcagctctttgtccttccattgtagcacgtgtgtagccctgggcataaaggccatgatgacttgacatcatcccctcttcctcgcgtct

SEQ ID NO: 274 - DNA, 220 bp, Unknown
  Description of Unknown: 16S RNA Operational Taxonomic Unit polynucleotide
  Phylum: Proteobacteria; Class: Deltaproteobacteria; Order: Syntrophobacterales; Family: Syntrophobacteraceae
aaggcccgggaacgtattcaccgcggcgttctgatccgcgattactagcgattccagcttcatggagtcgagttgcagactccaatccgaactgagagcggctttttgggattggctcccctcgcgggttagcgaccctttgtaccgcccattgtagcacgtgtgtggccctggacataagggccatgatgacttgacgtcgtcccaccttcctccggct

SEQ ID NO: 275 - DNA, 220 bp, Unknown
  Description of Unknown: 16S RNA Operational Taxonomic Unit polynucleotide
  Phylum: Acidobacteria; Class: Acidobacteria; Order: Acidobacteriales
aaggcccgggaacgtattcaccgcggcgtgctgatccgcgattactagcgattccaacttcatgcaggcgagttgcagcctgcaatccgaactgagaccgactttctccgattagctccaccttgcggcatcgcgacggtttgtatcgcccattgtagcacgtgtgtagccctggatataaaggccatgctgacttgacgtcatccccaccttcctccgg

SEQ ID NO: 276 - DNA, 220 bp, Unknown
  Description of Unknown: 16S RNA Operational Taxonomic Unit polynucleotide
  Phylum: Gemmatimonadetes; Class: Gemmatimonadetes; Order: Gemmatimonadales; Family: Gemmatimonadaceae
aaggccggaacgtagttcaccgtggcgctgctgatccacgattactagcaattccggcttcatgtagtcgagttgcagactacaatccgaactgaggaccgctttctgggattggcaccacctcgcggcttcgcaaccctttgtacggtccattgtagcacgtgtgtagccctagacgtaagggccatgatgacttgacgtcgtccccaccttcctccgg

SEQ ID NO: 277 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatggagtcgagttgcagactccaatctgaactgagtagggcgttttttgggattagcttcacatcactgtgtttgcagccctttgtacgccccattgtagcacgtgtgtagccctgggcataaaggccatgatgacttgacatcatcccctccttcct

SEQ ID NO: 278 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcgttgctgatatacgattactagcgattccagcttcatgcaggcgagttgcagcctgcaatctgaactgagagaggttttttgagattagcatcctgtcaccaggtagcagccctttgtacccccattgtagcacgtgtgtagccctgggcataaaggccatgatgacttgacatcatcccctccttctcacgt

SEQ ID NO: 279 - DNA, 220 bp, Unknown
  Description of Unknown: 16S RNA Operational Taxonomic Unit polynucleotide
  Phylum: Proteobacteria; Class: Gammaproteobacteria; Order: Xanthomonadales; Family: Xanthomonadaceae
aaggcccgggaacgtattcaccgcggcatagctgatccgcgattactagcgattccgacttcatggagtcgagttgcagactccaatccggactgggatcggctttctgggattggctccacctcgcggtcttgcaaccctctgtaccgaccattgtagtacgtgtgtagccctggccgtaagggccatgatgacttgacgtcatccccacttcctccgg

SEQ ID NO: 280 - DNA, 220 bp, Unknown
  Description of Unknown: 16S RNA Operational Taxonomic Unit polynucleotide
  Phylum: Cyanobacteria; Class: Synechococcophycideae; Order: Pseudanabaenales; Family: Pseudanabaenaceae
agggcccgggaacgtattcaccgcagtatgctgacctgcgattactagcgattccgccttcatgcaggcgagttgcagcctgcaatctgaactgagccacggtttatgggattagcgcaccatcgctggctggcaaccctttgtccgtagcattgtagtacgtgtgtagcccaggacgtatggggcatgctgacttgacgtcatccacaccttcctccgg

SEQ ID NO: 281 - DNA, 220 bp, Unknown
  Description of Unknown: 16S RNA Operational Taxonomic Unit polynucleotide
  Phylum: Chloroflexi; Class: SOGA31
aaggcccgggaacatattcaccgccgtatgctgaccggcggttactagcaactccggcttcatgcaggcgagttgcagcctgcaatccgaactgagaccggctttaagggattcgctccacctcgcggtttcgccgcccgttgtaccggccattgtagcgtgggtgtagcccaggcgtaaggggccatgctgacttgacgtcatccccaccttcctccga

SEQ ID NO: 282 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcacgcagtcgagttgcagactgcgatctgaactgagagaaggttttgggattggctccttatcgctaagtggcagccctttgtccttcccattgtagcacgtgtgtagccctgggcataaaggccatgatgacttgacatcatcccctccttctcgcgt

SEQ ID NO: 283 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccggacgtatcaccgtatcattgctgatatacgattactagcgattccagcttcatggagtcgagttgcagactccaatctgaactgagaggcgtttttgggattagcttcatatcactatgttgcagccctttgtacgccccattgtagcacgtgtgtagccctgggcataaaggccatgatgacttgacatcatcccctcttcctcacgtctt

SEQ ID NO: 284 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Bradyrhizobiaceae
aaggcccggaacgtattcccgtggcatgctgatccacgattactagcgattccaacttcatgggctcgagttgcagagcccaatccgaactgagacggctttttgagatttgctggggcttgcgcctttgcatcccattgtcaccgccattgtagcacgtgtgtagcccagcccgtaagggccatgaggacttgacgtcatccccacttcctcgcggctt

SEQ ID NO: 285 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales; Family: Saprospiraceae
aaggtccgggaacgtattcaccgcgccatggctgatgcgcgattactagcgattccaacttcatggagtcgggtttcagactccaatccgaactgagaccggctttacgggattggctccaccttgcggtttggcaaccctctgtaccggccattgtagcacgtgtgtcgccctgggcataagccatgatgacttgacgtcgtccccacttcctctcggc

SEQ ID NO: 286 - DNA, 220 bp, Unknown
  Description of Unknown: 16S RNA Operational Taxonomic Unit polynucleotide
  Phylum: Acidobacteria; Class: Solibacteres; Order: Solibacterales; Family: Solibacteraceae
aaggcccgggaacgtattcacggcgtcgatctgatacgccattactagcgattccagcttcatgcagtcgagttgcagactgcaatccgaactgagcagagttttatccattagctccccctcgcgggttggcaacggtttgtaccctgcattgtaacacgtgtgtagccctgggacataaaggccatgcggacttgacgtcatccccaccttcctctcc

SEQ ID NO: 287 - DNA, 220 bp, Unknown
  Description of Unknown: 16S RNA Operational Taxonomic Unit polynucleotide
  Phylum: Proteobacteria; Class: Betaproteobacteria; Order: Burkholderiales
aagacccgggaacgtattcaccgcggcaagctgatccgcgattactagcgattccgacttcacgcagtcgagttgcagactacgatccggactacgaccggttttctgggattagctcccctcgcgggttggcaaccctctgtaccggccattgtatgacgtgtgaagccctacccataagggccatgaggacttgacgtcatccccaccttcctccggt

SEQ ID NO: 288 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatggagtcgagttgcagactccaatctgaactgagagcgtttttgggattggctccttatcgctaagtggcagccctttgtacgcccattgtagcacgtgtgtagccctgggcataaaggccatgatgacttgacatccatcccctcttcctcgcgtc

SEQ ID NO: 289 - DNA, 220 bp, Unknown
  Description of Unknown: 16S RNA Operational Taxonomic Unit polynucleotide
  Phylum: Gemmatimonadetes; Class: Gemmatimonadetes; Order: Gemmatimonadales; Family: Gemmatimonadaceae
aaggcccgggaacgtattcaccgcggcattgctgatccgcgattactagcgattccagcttcatgccgtcgagttgcagacgacaatccgaactgaggcgggtttacgggattggcttgccgttgccggctcgcggccctctgtccccgccattgtagcacgtgtgtagccctagacgtaaggaccatgatgacttgacgtcatccccacttcctccggt

SEQ ID NO: 290 - DNA, 220 bp, Unknown
  Description of Unknown: 16S RNA Operational Taxonomic Unit polynucleotide
  Phylum: Proteobacteria; Class: Betaproteobacteria; Order: Methylophilales; Family: Methylophilaceae
aagacccgggaacgtattcaccgcgacattctgatccgcgattactagcgattccgacttcatgtagtcgagttgcagactacaatccggactacgatcggctttctgggattggctcccctcgcgggttggcaaccctctgtaccgaccattgtattacgtgtgaagccctggccataagggccatgaggacttgacgtcatccccaccttcctccggg

SEQ ID NO: 291 - DNA, 220 bp, Unknown
  Description of Unknown: 16S RNA Operational Taxonomic Unit polynucleotide
  Phylum: Proteobacteria; Class: Deltaproteobacteria; Order: Myxococcales
aaggcccgggaacgtattcaccgctgcctgctgatcagcgattactagcgattccgacttcaaagagtcgagttgcagactcttatctgtactgaggtcggttttttgcgattggctccccctcgcgggtttgcagcgctttgtaccgaccattgtagcacgtgtgtagccctggacataagggccatgatgacttgacgtcatccccaccttcctccgg

SEQ ID NO: 292 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Nakamurellaceae
aaggcccgggaacgtattcaccgcagcgttgctgatctgcgattactagcgactccgacttcatggggtcgagttgcagaccccaatccgaactgagaccggctttttgggtattcgctccacctcacggtttcgcagccctttgtaccggccatttgtagcatgcgtgaagcccaagacataaggggcatgatgatttgacgtcatccccacctttcct

SEQ ID NO: 293 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtagcgttgctgatctacgattactagcgattccagcttcatgcaggcgagttgcagcctgcaatctgaactgagataacttttttggattagctccttatcactaagtggcagccctttgtagttaccattgtagcacgtgtgtagccctgggcataaaggccatgatgacttgacatcatccctccttcctcacgc

SEQ ID NO: 294 - DNA, 220 bp, Unknown
  Description of Unknown: 16S RNA Operational Taxonomic Unit polynucleotide
  Phylum: Proteobacteria; Class: Alphaproteobacteria; Order: Rhizobiales
aaggcccggaacgtattcaccgcggcatgctgatccgcgattactagcgattccgacttcatgcactcgagttgcagagtgcaatctgaactgagacggtttggggattagcatcacatcgctgtgtcgctgcccactgtcaccgccattgtagcacgtgtgtagcccagcccgtaagggccatgatgacttgacgtcatccccaccttcctccggctta

SEQ ID NO: 295 - DNA, 220 bp, Unknown
  Description of Unknown: 16S RNA Operational Taxonomic Unit polynucleotide
  Phylum: Proteobacteria; Class: Gammaproteobacteria; Order: Chromatiales; Family: Sinobacteraceae
aagacccgggaacgtattcaccgcagcaatgctgatctgcgattactagcgattccgacttcatggagtcgagttgcagactccaatccggactacgattagatttttctgggattggctcccgctcgcgcgttggcttccctctgtatctaccattgtagcacgtgtgtagccctggtcataaaggccatgatgacttgacgtcatccccaccttcctc

SEQ ID NO: 296 - DNA, 220 bp, Unknown
  Description of Unknown: 16S RNA Operational Taxonomic Unit polynucleotide
  Phylum: Nitrospirae; Class: Nitrospira; Order: Nitrospirales; Family: Nitrospiraceae
aaggcccgggaacgtattcaccccggcgtgctgatccgggattactagcgattccgccttcacgaggtcgagttgcagacctcgatctgaactgaggtccggttttttgcgattggcctcccccttacgggtttgcagcgctttgtgccggccattgtagcacgtgtgtagccctaggcataaaggccatgctgacttgacgtcatccccaccttcctcc

SEQ ID NO: 297 - DNA, 220 bp, Unknown
  Description of Unknown: 16S RNA Operational Taxonomic Unit polynucleotide
  Phylum: Chloroflexi; Class: SOGA31
aaggcccgggaacatattcaccgccgtatgctgaccggcggttactagcaactccggcttcatgtaggcgagttgcagcctacaatccgaactgagaccggctttcagggattcgctccacctcgcggtttcgcagcccgttgtaccggccattgtagcgtgggtgtagcccaggacgtaagggccatgctgacttgacgtcatccccacttccccgagt

SEQ ID NO: 298 - DNA, 220 bp, Unknown
  Description of Unknown: 16S RNA Operational Taxonomic Unit polynucleotide
  Phylum: Proteobacteria; Class: Betaproteobacteria; Order: Burkholderiales
aagacccgggaacgtattcaccgcggcaagctgatccgcgattactagcgattccgacttcacgcagtcgagttgcagactgcgatccggacacgaccggtttcttgggattagctccccctcgcggttggcagccctctgtaccggccattgtatgacgtgtgtagccctacccataagggccatgaggacctgacgtcatccccacttcctccggttg

SEQ ID NO: 299 - DNA, 220 bp, Unknown
  Description of Unknown: 16S RNA Operational Taxonomic Unit polynucleotide
  Phylum: Acidobacteria; Class: Acidobacteria; Order: Acidobacteriales
aaggcccggacgtattcaccgcggcgtgctgatccgcgattactagcgattccaacttcatgcaggcgagttgcagcctacaatccgaactgagaccagctttatccgattagctcacctcgcgagtttgcaacggtttgtaccggccattgtagcacgtgtgtggccccagacataaaggccatgctgacttgacgtcatccccaccttcctccggttt

SEQ ID NO: 300 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Bradyrhizobiaceae
aaggcccgggaacgtattcaccgtggcgtgctgatccacgattactagcgattccaacttcatgggctcgagttgcagagcccaatccgaactgagacggctttttgagatttgcgaagggtcgcccttagcatccaattgtcaccgccattgtagcacgtgtgtagcccagccgtaacgggccatgaggacttgacgtcatccccaccttcctcgcggc

SEQ ID NO: 301 - DNA, 220 bp, Unknown
  Description of Unknown: 16S RNA Operational Taxonomic Unit polynucleotide
  Phylum: Proteobacteria; Class: Alphaproteobacteria; Order: Rhodospirillales; Family: Rhodospirillaceae
aaggcccgggaacgtattcaccgcggcatgctgatccgcgattactagcgattccgacttcatgctctcgagttgcagagagcaatccgaactgagacggttttcgagattggctcgggctcgcaccctcgctcccctctgtcaccgccattgtagcacgtgtgtagcccagcccataagggccatgaggacttgacgtcatccccgcccttccctggcc

SEQ ID NO: 302 - DNA, 220 bp, Unknown
  Description of Unknown: 16S RNA Operational Taxonomic Unit polynucleotide
  Phylum: Acidobacteria; Class: Chloracidobacteria
acaagacccgggaacgtattcaccgcagcattctgatctgcgattactagcgattccaacttcatgaagtcgagttgcagacttcaatccgaactgagaccggttttgcgattagctccctcttacgagattgcgacgttttgtaccggccattgtagcacgtgtgtagccctaagcataaaggccatgatgacttgacatcatccccaccttcctccgt

SEQ ID NO: 303 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatgcagtcgagttgcagaccgcaatctgaactgagaagaggtttttgggattagctccttgtcgccaagtggcagccctttgtcctccccattgcagcacgtgtgtagccccgggcataaaggccatgatgacttgacatcatcccatccttcctcac

SEQ ID NO: 304 - DNA, 220 bp, Unknown
  Description of Unknown: 16S RNA Operational Taxonomic Unit polynucleotide
  Phylum: Verrucomicrobia; Class: Spartobacteria; Order: Spartobacteriales; Family: Spartobacteriaceae
aaggcccgggaacgtattcacggcgccgtagctgatgcgccattactagcgattccggcttcatggaggcgagttgcagcctccaatccgaactgagcccagttttactagattcctccacctcgcggtctcggatcgttctgtactgagcattgtagtacgtgtgcagccctggccgtaagggccatactgacttgacgtcgtccccacttcctccccg

SEQ ID NO: 305 - DNA, 220 bp, Unknown
  Description of Unknown: 16S RNA Operational Taxonomic Unit polynucleotide
  Phylum: Proteobacteria; Class: Alphaproteobacteria; Order: Sphingomonadales
aaggcctgggaacgtattcaccgcggcatgctgatccgcgattactagcgattccgccttcatgctctcgagttgcagagaacaatccgaactgagacggctttttgggagttgtctcactctcgcgagtttgtctgcccattgtcaccgccattgtagcacgtgtgtagcccagcgtgtaagggccatgaggacttgacgtcatccccaccttcctccg

SEQ ID NO: 306 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Nocardiaceae
gaggcccgggaacgtattcaccgcagcgttgctgatctgcgattactagcgactccgacttcacggggtcgagttgcagaccccgatccgaactgagaccagctttaagggattcgctccacctcacggtctcgcagccctctgtactggccattgtagcatgtgtgaagccctggacataaggggcatgatgacttgacgtcgtccccacttcctccga

SEQ ID NO: 307 - DNA, 220 bp, Unknown
  Description of Unknown: 16S RNA Operational Taxonomic Unit polynucleotide
  Phylum: Proteobacteria; Class: Gammaproteobacteria; Order: Xanthomonadales; Family: Xanthomonadaceae
aaggcccgggaacgtattcaccgcggcaatgctgatccgcgattactagcgattccgacttcacggagtcgagttgcagactccgatccggactaggatggggtttctgggattggctccggctcgcgccttggcgaccctctgtccccaccattgtagtacgtgtgtagccctcggccgtaagggccgactgatgacttgacgtcatccccacccttcc

SEQ ID NO: 308 - DNA, 220 bp, Unknown
  Description of Unknown: 16S RNA Operational Taxonomic Unit polynucleotide
  Phylum: Proteobacteria; Class: Betaproteobacteria
acaagacccgggaacgtattcaccgcggcatgctgatccgcgattactagcgattccgacttcatgcagtcgagttgcagactgcaatccggactacgaccggctttctgggattggctcccctcgcgggttggctaccctctgtaccggccattgtatgacgtgtgaagccctacccataagggccatgaggacttgacgtcatccccaccttcctccg

SEQ ID NO: 309 - DNA, 220 bp, Unknown
  Description of Unknown: 16S RNA Operational Taxonomic Unit polynucleotide
  Phylum: Firmicutes; Class: Bacilli; Order: Bacillales; Family: Alicyclobacillaceae
acaaggcccgggaacgaattcaccgcggcatgctgatccgcgattactagcaattccggcttcatgcaggcgagttgcagcctgcaatccgaactacgaacggctttctgggattggctccacctcgcggcttcgcaaccctttgtaccgcccattgtagcacgtgtgtagcccaggacataaggggcatgatgatttgacgtcatccccgccttcctcc

SEQ ID NO: 310 - DNA, 220 bp, Unknown
  Description of Unknown: 16S RNA Operational Taxonomic Unit polynucleotide
  Phylum: Acidobacteria; Class: Solibacteres; Order: Solibacterales; Family: Solibacteraceae
aaggcccgggaacgtattcacggcagcgtgctgatctgccattactagcgattccagcttcatgcaggcgagttgcagcctgcaatccgaactgagaccggtttttccgattggctccccctcgcgggtttgctgcggtttgtaccggccattgtagcacgtgtgtagccctggacataaaggccatgaggacttgacgtcatccccacttcctccagct

SEQ ID NO: 311 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Intrasporangiaceae
aaggcccgggaacgtattcaccgcagcgttgctgatctgcgattactagcgactccgacttcatggggtcgagttgcagaccccaatccgaactgagaccggtttttgggatcgctccacctcgcggtatcgcagccctttgtaccggccattgtagcatgcgtgaagcccaagacataaggggcatgatgatttgacgtcatccccaccttctccgagt

SEQ ID NO: 312 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Oxalobacteraceae
aagacccgggaacgtattcaccgcgacatgctgatccgcgattactagcgattccaacttcacgcagtcgagttgcagactgcgatccggactacgatgcactttctgggattagctccccctcgcgggttggtcggccctctgtatgcaccattgtatgacgtgtgaagccctaccccataagggccatgaggacttgacgtcatccccacccttcctc

SEQ ID NO: 313 - DNA, 220 bp, Unknown
  Description of Unknown: 16S RNA Operational Taxonomic Unit polynucleotide
  Phylum: Acidobacteria; Class: iii1-8; Order: DS-18
aaggcccgggaacgtattcaccgcggcgttctgatccgcgattactagcgattccagcttcatgcagtcgagttgcagactgcaatccgaactgagaacggctttgggattagctccacctcgcggctttgcgaccctttgtaccgtccattgtagcacgtgtgtagccctggacataaaggccatgaggacttgacgtcatccccacttcctccggttt

SEQ ID NO: 314 - DNA, 220 bp, Unknown
  Description of Unknown: 16S RNA Operational Taxonomic Unit polynucleotide
  Phylum: Verrucomicrobia; Class: Verrucomicrobiae; Order: Verrucomicrobiales
aaggcctggaacgtattcacggcgccgtagctgatgcgccattactagcgattccagcttcatgccgtcgagttgcagacgacaatctgaactgggcccggtttttagggatttgctccactttacagtcttgcttccctctgtgccgggcattgtagtacgtgtgcagccctggccgtaagggccatactgacttgacgtcatcccccaccttcctcct

SEQ ID NO: 315 - DNA, 220 bp, Unknown
  Description of Unknown: 16S RNA Operational Taxonomic Unit polynucleotide
  Phylum: Proteobacteria; Class: Alphaproteobacteria; Order: Rhizobiales
aaggcccggaacgtattcggaccgcggcatgctgatccgcgattactagcgattccaacttcatgcactcgagttgcagagtgcaatccgaactgagatggcttttggagattagctcggcctcgcggcctcgctgcccactgtcaccaccattgtagcacgtgtgtagcccagcccgtaagggccatgaggacttgacgtcatccccaccttcctctcg

SEQ ID NO: 316 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatgaagtcgagttgcagaccttcaatctgaactgagtagacgttttttgagattgggcttcacatcactgtgttgctgctctttgtacgcccattgtagcacgtgtgtagccctgggcataaaggccatgatgacttgacatcatcccccttcctcac

SEQ ID NO: 317 - DNA, 220 bp, Unknown
  Description of Unknown: 16S RNA Operational Taxonomic Unit polynucleotide
  Phylum: Acidobacteria; Class: Chloracidobacteria
aagacctgggaacgtattcaccgcagcgttctgatctgcgattactagcgattccaacttcatgaagtcgagttgcagacttcaatccgaactgagattggctttaaatgattagctcactcttacgagattgcgacattttgtaccaaccattgtagcacgtgtgtagccctgaacataaaggccatgatgacttgacatcatccccaccttcctccgt

SEQ ID NO: 318 - DNA, 220 bp, Unknown
  Description of Unknown: 16S RNA Operational Taxonomic Unit polynucleotide
  Phylum: Acidobacteria; Class: Acidobacteria; Order: Acidobacteriales
aaggcccgggaacgtattcaccgcggcatgctgatccgcgattactagcgattccaacttcatgcaggcgagttgcagcctgcaatccgaactgagaccgactttgtccgattagctccaccttgcggtctcgcgacggtttgtgtcggccattgtagcacgtgtgtagccccaagcataaaggccatgctgacttgacgtcatccccaccttcctccgt

SEQ ID NO: 319 - DNA, 220 bp, Unknown
  Description of Unknown: 16S RNA Operational Taxonomic Unit polynucleotide
  Phylum: Proteobacteria; Class: Alphaproteobacteria; Order: Sphingomonadales
aaggcctgggaacgtattcaccgcggcatgctgatccgcgattactagcgattccgccttcatgctctcgagttgcagagaacaatccgaactgagacggcttttggagattagctcaccctcgcgggatgctgccccactgtcaccgccattgtagcacgtgtgtagcccagcgcgtaagggccatgagggacttgacgtcatccccaccttcctccgg

SEQ ID NO: 320 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgcgccattgctgatgcgcgattactagcgattccagcttcatgtagtcgagttgcagactacaatctgaactgagaggaaggtttttgagatttgcatcctgtcaccaggtagcgtccctttgtcctcccattgtagcacgtgtgtagccctgggcataaaggccatgatgacttgacatcatcccctccttcctcac

SEQ ID NO: 321 - DNA, 220 bp, Unknown
  Description of Unknown: 16S RNA Operational Taxonomic Unit polynucleotide
  Phylum: Acidobacteria; Class: Solibacteres; Order: Solibacterales; Family: Solibacteraceae
gaggcccgggaacgtattcacggtatcgttctgatataccattactagcgattccagcttcatgcaggcgagttgcagcctgcaatccgaactgagaacggttttttccgattagctccctctcgcgagttcgcagcggtttgtaccgtccattgtagcacgtgtgtagccctggacataaaggccatgatgacttgacgtcatcccccttcctccagct

SEQ ID NO: 322 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcgttgctgatatacgattactagcgattccagcttcatgcagtcgagttgcagactgcaatctgaactgagataacttttttgggattagctccttatcactaagtggcagccctttgtagttaccattgtagcacgtgtgtagccctgggcataaaggccatgatgacttgacatcatcccctccttcctcag

SEQ ID NO: 323 - DNA, 220 bp, Unknown
  Description of Unknown: 16S RNA Operational Taxonomic Unit polynucleotide
  Phylum: Actinobacteria; Class: Actinobacteria; Order: Actinomycetales
aaggcccgggaacgtattcaccgcagcgttgctgatctgcgattactagcgactccgacttcatggggtcgagttgcagaccccaatccgaactgagtaccagttttttgggattccgctccacctcacggtttcgcagccctttgtactggccattgtagcatgcgtgaagcccaagacataaggggcatgatgatttgacgtcatccccacttcctcc

SEQ ID NO: 324 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Bradyrhizobiaceae
aaggcccgggaacgtattcaccgtggcgtgctgatccacgattactagcgattccaacttcatgggctcgagttgcagagcccaatccgaactgagacggctttttgagatttgtctagggacttgcgtcttcgcttcccattgtcaccgccattgtagcacgtgtgtagcccagcccgtaagggccatgaggacttgacgtcatccccacttctcgcgg

SEQ ID NO: 325 - DNA, 220 bp, Unknown
  Description of Unknown: 16S RNA Operational Taxonomic Unit polynucleotide
  Phylum: Proteobacteria; Class: Betaproteobacteria
aagacccgggaacgtattcaccgcggcaagctgatccgcgattactagcgattccgacttcacgcagtcgagttgcagactgcaatccggactacgaccggcttttatggggattggctccagctcgcgctttggcaaccctctgtaccggccattgtatgacgtgtgaagccctaccataagggccatgaggcttgacgtcatccccacttcctccggt

SEQ ID NO: 326 - DNA, 220 bp, Unknown
  Description of Unknown: 16S RNA Operational Taxonomic Unit polynucleotide
  Phylum: Proteobacteria; Class: Betaproteobacteria
aagacccggaacgtattcgaccgcgacatgctgatccgcgattactagcgattccgacttcacgcagtcgagttgcagactgcgatccggactacgatcggctttctgggattggctcccctcgcgggttggctgccctctgtaccgaccattgtatgacgtgtgaagccctacccataagggccatgaggacttgacgtcatccccaccttcctccggt

SEQ ID NO: 327 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatggagtcgagttgcagactccaatctgaactgagaggcgttttttgggattagcttcacgtcgccgtgttgcagccctttgtacgccccattgtagcacgtgtgtagccctggcataaaggcccatgatgacttgacatcatcccctccttcctcac

SEQ ID NO: 328 - DNA, 220 bp, Unknown
  Description of Unknown: 16S RNA Operational Taxonomic Unit polynucleotide
  Phylum: Proteobacteria; Class: Alphaproteobacteria; Order: Caulobacterales; Family: Caulobacteraceae
aaggcccggggaacgtattcaccgcggcatgctgatccgcgattactagcgattccaacttcatgcactcgagttgcagagtgcaatccgaactgagacgacttttagggattggctcccctcgcgggattgcagccctctgtagtcgccattgtagcacgtgtgtagcccaccttgtaagggccatgaggacttgacgtcatcccaccttcctccgagc

SEQ ID NO: 329 - DNA, 220 bp, Unknown
  Description of Unknown: 16S RNA Operational Taxonomic Unit polynucleotide
  Phylum: Acidobacteria; Class: Acidobacteria; Order: Acidobacteriales
aaggcctgggaacgtattcaccgcggcatgctgatccgcgattactagcgattccaacttcatgcaggcgagttgcagcctacaatccgaactgagacggactttatgcgattggctcaccctcgcgggtttgcagcgctttgtatccgccattgtagcacgtgtgtggccctggacataaaggccatgctgacttgacgtcatcccaccttcctccggt

SEQ ID NO: 330 - DNA, 220 bp, Unknown
  Description of Unknown: 16S RNA Operational Taxonomic Unit polynucleotide
  Phylum: Gemmatimonadetes; Class: Gemmatimonadetes; Order: Gemmatimonadales; Family: Gemmatimonadaceae
aaggcccgggaacgtattcaccgtggcgtagctgatccacgattactagcgattccagcttcatgccgtcgagttgcagacgacaatccgaactgaggcgggtttcggggattggctcgccgttgccggctcgcgaccctctgtcccgccattgtagcacgtgtgtagccctagacgtaaggaccatgatgacttgacgtcgtccccaccttcctccgcc

SEQ ID NO: 331 - DNA, 220 bp, Unknown
  Description of Unknown: 16S RNA Operational Taxonomic Unit polynucleotide
  Phylum: Actinobacteria; Class: Actinobacteria; Order: MC47
acaaggcccgggaacgtattcaccgcggcaatgctgatccgcgattactagcaactccgccttcatgaaggcgagtttcagccttcaatccgaaccgggaccggctttttgggattcgctccccctcacgggtttgcagccctttgtaccggccaatgtagcacgtgtgtagccctggacataagggtcatgctgacttgacatcatccccaccttcctc

SEQ ID NO: 332 - DNA, 220 bp, Unknown
  Description of Unknown: 16S RNA Operational Taxonomic Unit polynucleotide
  Phylum: Chloroflexi
aaggcccgggaacatattcaccgtagtgtgctgacccacggttactagcaactccgacttcaagcaggcgagttgcagcctgctatccgaactgagactggcttttttgagattgctccacctcgcggtcttgcttccctttgtaccagccattgtagcgtgtgtgtagccccagaacgtaagagccatgctgacttgacgtcatccccaccttcctccg

SEQ ID NO: 333 - DNA, 220 bp, Unknown
  Description of Unknown: 16S RNA Operational Taxonomic Unit polynucleotide
  Phylum: Firmicutes; Class: Bacilli; Order: Bacillales; Family: Paenibacillaceae
aagacccgggaacgtattcaccgcggcatgctgatccgcgattactagcaattccgacttcatgcaggcgagttgcagcctgcaatccgaactgagaccggctttgctgggattggctccacctcgcggcttcgcttcccgttgtaccggcattgtagtacgtgtgtagcccaggtcataagggcatgatgatttgacgtcatccccaccttcctccggt

SEQ ID NO: 334 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aaggcccgggaacgtattcaccgcagcactgctgatctgcgattactagcaactccgacttcatggggtcgagttgcagaccccaatccgaactgagacaggctttttgagattcgctccgcctcacggcttcgcagctcattgtacctgccattgtagcaccgtgtgcagcccaagacataaggggcatgactgaccttgacgtcgtccccaccttcct

SEQ ID NO: 335 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Bradyrhizobiaceae
aaggcccgggaacgtattcaccgtggcgtgctgatccacgattactagcgattccaacttcatgggctcgagttgcagagcccaatccgaactgagacggctttttgagatttgctaggggttgccccttcgcgtccacttgtcaccgccattgtagcacgtgtgtagcccacgcccgtaagggccatgaggacttgacgtcatccccacccttcctcgc

SEQ ID NO: 336 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatgaggtcgagttgcagacctcaattcgaactgagagaaggtttttgagattagcatcctgttaccaggtagcaaccctttgtccttcccattgtagcacgtgtgtagccctgggcataaaggccatgatgacttgacatcatcccctccttctcgcg

SEQ ID NO: 337 - DNA, 220 bp, Unknown
  Description of Unknown: 16S RNA Operational Taxonomic Unit polynucleotide
  Phylum: Proteobacteria; Class: Betaproteobacteria
aagacccggaacgtattcaccgcgacatgctgatccgcgattactagcgattccgacttcacgcagtcgagttgcagactgcgatccggactacgaacggctttctgggatggctccacctcgcggcttggcaaccctctgtaccgtccattgtatgacgtgtgaagccctacccataagggccatgaggacttgacgtcatccccaccttcctccggtt

SEQ ID NO: 338 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Nocardioidaceae
aaggcccgggaacgtattcaccgcagcgttgctgatctgcgattactagcgactccgacttcatggggtcgagttgcagaccccaatccgaactgagaccggctttttggattcgctccacattgctgtttcgcagccctttgtaccggccattgtagcatgcttgaagccctaggcataagggcatgagacttgacgtcatccccaccttctccgagtt

SEQ ID NO: 339 - DNA, 220 bp, Unknown
  Description of Unknown: 16S RNA Operational Taxonomic Unit polynucleotide
  Phylum: Acidobacteria
aaaggcccgggaacgtattcaccgcggcgttctgatccgcgattactagcgattccagcttcatggagtcgagttgcagactccaatccgaactgaggtcggctttttccgattagctccccctcgcgggtttgcgacgttttgtaccgaccattgtagcacgtgtgtagccctggacataaaggccatgaggacttgacgtcatccccactcctccggt

SEQ ID NO: 340 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatggagtcgagttgcagactccaatctgaactgagagaaggtttttgggattcgctccttatcactaagtggcagccctttgtcctccccattgtagcacgtgtgtagccctgggcataaaggccatgatgacttgacatcattcccctccttcctcg

SEQ ID NO: 341 - DNA, 220 bp, Unknown
  Description of Unknown: 16S RNA Operational Taxonomic Unit polynucleotide
  Phylum: Chloroflexi; Class: SOGA31
aaggcccgggaacatattcaccgccgtatgctgaccggcggttactagcaactccggcttcatgcaggcgagttgcagcctacaatccgaactgagaccggctttaagggattagctccacctcgcggtttgcaggcccgttgtaccggccattgtagcgtgggtgtagcccaggacgtaagggccatgctgacttgacgtcatccccacttcctccgag

SEQ ID NO: 342 - DNA, 220 bp, Unknown
  Description of Unknown: 16S RNA Operational Taxonomic Unit polynucleotide
  Phylum: Proteobacteria; Class: Betaproteobacteria
aagacccgggaacgtattcaccgcgacatgctgatccgcgattactagcgattccgacttcatgctctcgagttgcagagaacaatccggactacgaccggctttctgggatttgctcccctcgcgggttggcagccctctgtaccggccattgtattacgtgtgaagccctacccataagggccatgaggacttgacgtcatccccacttcctccggtt

SEQ ID NO: 343 - DNA, 220 bp, Unknown
  Description of Unknown: 16S RNA Operational Taxonomic Unit polynucleotide
  Phylum: Actinobacteria; Class: Actinobacteria; Order: MC47
aagccccgtgtacgtattcaccgcggcgttgctgatccgcgattactagcaactccgccttcatgaaggcgagtttcagccttcaatccgaaccgggaccggctttttgggattcgctcactctcacaagtttgcagcccctttgtaccggccaatgtagcacgtgtgtagcccaggacataaggggcatgatgacttgacatcatccccaccttcctcc

SEQ ID NO: 344 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Bradyrhizobiaceae
aaggcccgggaacgtattcaccgtggcgtgctgatccacgattactagcgattccaacttcatgggctcgagttgcagagcccaatccgaactgagacggctttttgagattgccaggacttgcgtcttcgcatcccattgtcaccgccattgtagcacgtgtgtagcccagcccgtaagggccatgaggacttgacgtcatccccaccttcctcgggtt

SEQ ID NO: 345 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Hyphomicrobiaceae
acaaggcccgggaacgtattcaccgcagcgtgctgatctgcgattactagcaattccaacttcatgcactcgagttgcagagtgcaatccgaactgagacggcttttagggattagcatgtcctcgcggactagctgccctctgtcaccgccattgtagcacgtgtgtagcccagcccgtaagggccatgaagacttgacgtcatccccaccttcctccg

SEQ ID NO: 346 - DNA, 220 bp, Unknown
  Description of Unknown: 16S RNA Operational Taxonomic Unit polynucleotide
  Phylum: Actinobacteria; Class: Actinobacteria; Order: MC47
aagacccggaacatattcaccgcggcgttgctgatccgcgattactagcaactccaccttcatggaggcgagtttcagcctccaatccgaaccgagaccgctttttgggattcgctcaccctcgcaggtttgcagccctttgtaccggccaatgtagcacgtttgtagcccaagacataaggggcatgatgacttgacgtcatccccacttcctccgatt

SEQ ID NO: 347 - DNA, 220 bp, Unknown
  Description of Unknown: 16S RNA Operational Taxonomic Unit polynucleotide
  Phylum: Proteobacteria; Class: Betaproteobacteria
aagaccccgggaacgtattcaccgcgacatgctgatccgcgattactagcgattccgacttcatgcagtcgagttgcagactgcaatccggactacgaccggctttatggggattggctccgcctcgcggcttggcaaccctctgtaccggccattgtatgacgtgtgaagccctacccataagggccatgaggacttgacgtcatccccaccttcctcc

SEQ ID NO: 348 - DNA, 220 bp, Unknown
  Description of Unknown: 16S RNA Operational Taxonomic Unit polynucleotide
  Phylum: Proteobacteria; Class: Gammaproteobacteria; Order: Chromatiales; Family: Sinobacteraceae
aagacccgggaacgtattcaccgcagcaatgctgatctgcgattactagcgattccgacttcatggagtcgagttgcagactccaatccggactacgacaggttttctgggattagctccctctcgcgagtttggcttcccctctgtacctgccattgtagcacgtgtgtagccctggtcataaaggccatgatgacttgacgtcatccccaccttcctc

SEQ ID NO: 349 - DNA, 220 bp, Unknown
  Description of Unknown: 16S RNA Operational Taxonomic Unit polynucleotide
  Phylum: Acidobacteria; Class: Chloracidobacteria
aagaccggaacgtattcaccgcagcatgctgatctgcgattactagcgattccaacttcatgcagtcgagttgcagactgcaatccgaactgagaccggtttttccgattggctccgtctcgcgacttcgcgacggtttgtaccggccattgtagcacgtgtgtagccctggacataaaggccatgaggacttgacgtcatccccaccttctccggttta

SEQ ID NO: 350 - DNA, 220 bp, Unknown
  Description of Unknown: 16S RNA Operational Taxonomic Unit polynucleotide
  Phylum: Acidobacteria; Family: Koribacteraceae
aaggcccgggaacgtattcaccgcagcgtgctgatctgcgattactagcgattccagcttcatggagtcgagttgcagactccaatccgaactgaggatgactttttccgattagctcccctcgcgggtttgcgacgtttgtatcacccattgtagcacgtgtgtagccctggacataaaggccatgaggacttgacgtcatccccaccttcctcccgtt

SEQ ID NO: 351 - DNA, 220 bp, Unknown
  Description of Unknown: 16S RNA Operational Taxonomic Unit polynucleotide
  Phylum: Proteobacteria; Class: Alphaproteobacteria; Order: Rhizobiales
aaggccggaacgtattcaccgtggcattctgatccacgattactagcgattccaacttcatgcactcgagttgcagagtgcaatccgaactgagacggcttttggagattagctcaccctcgcgggttagctgcccattgtcaccgccattgtagcacgtgtgtagcccagcccgtaagggccatgaggacttgacgtcatccccaccttcctctcggct

SEQ ID NO: 352 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgcgccattgctgatgcgcgattactagcgattccagcttcacggagtcgagttgcagactccgatctgaactgagagggagttttgagattagcatcctgtcaccaggtagcgaccctttgtctcccccattgtagcacgtgtgtagccctgggcataaaggccatgatgacctgacatcatcccctccttcctcgcg

SEQ ID NO: 353 - DNA, 220 bp, Unknown
  Description of Unknown: 16S RNA Operational Taxonomic Unit polynucleotide
  Phylum: Proteobacteria; Class: Betaproteobacteria
aagacccgggaacgtattcaccgcgacatgctgatccgcgattactagcgattccgacttcatggagtcgagttgcagactccaatccggactacgacgcgctttgcgggattggctccagatcgctccttggcaaccctctgtacgcgccattgtattacgtgtgaagccctaccataagggccatgaggacttgacgtcatcccccttcctccggtct

SEQ ID NO: 354 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggacgtattcaccgtatcattgctgatatacgattactagcgattccagcttcatggagtcgagttgcagactccaatctgaactgagaagaggttttgggattagctccttatcactaagtggcagccctttgtcctctccattgtagcacgtgtgtagccctgggcataaggccatgatgacttgacatcatcccctccttcctcacgtc

SEQ ID NO: 355 - DNA, 220 bp, Unknown
  Description of Unknown: 16S RNA Operational Taxonomic Unit polynucleotide
  Phylum: Proteobacteria; Class: Betaproteobacteria; Order: Burkholderiales
aagacccgggaacgtattcaccgcgacatgctgatccgcgattactagcgattccaacttcatgcagtcgagttgcagactgcgatccggactacgaccggttttctgggattggctccccctcgcgggttggcagccctctgtaccggccattgtatgacgtgtgtagccctacccataagggccatgaggacctgacgtcatccccaccttcctccgt

SEQ ID NO: 356 - DNA, 220 bp, Unknown
  Description of Unknown: 16S RNA Operational Taxonomic Unit polynucleotide
  Phylum: Proteobacteria; Class: Alphaproteobacteria; Order: Rhodospirillales; Family: Rhodospirillaceae
acaaggcccgggaacgtattcaccgcggcgtgctgatccgcgattactagcgattccaacttcacgcacccgagttgcagagtgcgatccgaactgagatggcttttggagattggctcgatctcgcgatctcgctgcccactgtcaccaccattgtagcacgtgtgtagcccagcccataagggccatgaggacttgacgtcatccccgcttctccggc

SEQ ID NO: 357 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Brucellaceae
aaggcccgggaacgtattcaccgcggcatgctgatccgcgattactagcgattccaacttcatgcactcgagttgcagagtgcaatccgaactgagatggcttttggagattagctcacactcgcgtgctcgctgcccactgtcaccaccattgtagcacgtgtgtagcccagcccgtaagggccatgaggacttgacgtcatccccacttcccggctat

SEQ ID NO: 358 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatggagtcgagttgcagactccaatctgaactgagagaaggtttttgggattggctccttatcgctaagtggcagccctttgtccttcccattgtagcacgtgtgtagccctggggcataaaaggccatgatgacttgacatcatcccctccttcctc

SEQ ID NO: 359 - DNA, 220 bp, Unknown
  Description of Unknown: 16S RNA Operational Taxonomic Unit polynucleotide
  Phylum: Chloroflexi; Class: Bljii12; Order: AKYG885; Family: Dolo_23
agggcccgggaacgtattcaccgcagtgtgctgacctgcggttactagcaactccgcgttcatgcaggcgagttgcagcctgcaatcccaactgagaccggctttggtgcgattcgctccgggtcgccccatcgctgcgcgttgtaccggccattgtagcgtgtgtgtagccctggacgtaagagccgtgctgacttgacgtcatccccaccttcctccg

SEQ ID NO: 360 - DNA, 220 bp, Unknown
  Description of Unknown: 16S RNA Operational Taxonomic Unit polynucleotide
  Phylum: Proteobacteria; Class: Betaproteobacteria
aagacccgggaacgtattcaccgcgacatgctgatccgcgattactagcgattccgacttcatgcagtcgagttgcagactgcaatccggactacgacgcgctttttagggagttggctccacctcgcggcttggcaaccctctgtacgcgccattgtattacgtgtgaagccctacccataagggccatgaggacttgacgtcatcccccaccttcctc

SEQ ID NO: 361 - DNA, 220 bp, Unknown
  Description of Unknown: 16S RNA Operational Taxonomic Unit polynucleotide
  Phylum: Armatimonadetes; Class: CH21
aagacccgggaacgtattcaacgcagtatagctgacctgcgtttactagcgattccgccttcatgcagtcgagttgcagactgcaatctgaactgggggcgtatttttgggattgctccacctcacggtattgctgccctttgttgcgcccattgtagcatgtgtgaagccccagacgtaactgccatgctgacttgacgtcatccccacttcctccgat

SEQ ID NO: 362 - DNA, 220 bp, Unknown
  Description of Unknown: 16S RNA Operational Taxonomic Unit polynucleotide
  Phylum: Proteobacteria; Class: Betaproteobacteria
aagacccggaacggtattcaccgcgacatgctgatccgcgattactagcgattccgacttcatgcagtcgagttgcagactgcaatccggactacgaccggctttctggggagttggctccgcctcgcggcttggcaaccctctgtaccggccattgtatgacgtgtgaagccctacccataagggccatgaggacttgacgtcatccccaccttcctcc

SEQ ID NO: 363 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Oxalobacteraceae
aagacccgggaacgtattcaccgcggcatgctgatccgcgattactagcgattccaacttcatgcagtcgagttgcagactgcaatccggactacgatacactttctgggattggctcccctcgcgggttggcaaccctctgtatgtaccattgtatgacgtgtgaagcctacccataagggccatgaggacttgacgtcatccccactcctccggttgt

SEQ ID NO: 364 - DNA, 220 bp, Unknown
  Description of Unknown: 16S RNA Operational Taxonomic Unit polynucleotide
  Phylum: Acidobacteria; Class: Chloracidobacteria
aagacccgggaacgtattcaccgcagcatgctgatctgcgattactagcgattccagcttcatggagtcgagttgcagactccaatccgaactgagacccggttttttgtcgattggctcccccttgcaggtttgcagcgctttgtaccggccattgtagcacgtgtgtagccctggacataaaggccatgaggacttgacgtcatccccaccttcctcc

SEQ ID NO: 365 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Comamonadaceae
aagacccggaacgtattcaccgcgacattctgatccgcgattactagcgattccgacttcacgcagtcgagttgcagactgcgatccggactacgactggttttctgggattagctccccctcgcgggttggcaaccctctgtaccagccattgtatgacgtgtgtagccccacctataagggccatgaggacttgacgtcatccccaccttcctccggt

SEQ ID NO: 366 - DNA, 220 bp, Unknown
  Description of Unknown: 16S RNA Operational Taxonomic Unit polynucleotide
  Phylum: Bacteroidetes; Class: Flavobacteria; Order: Flavobacteriales; Family: Flavobacteriaceae
aaggccggaacgtattcaccggatcatggctgatatccgattactagcgattccagcttcacggagtcgagttgcagactccgatccgaactgagaacggttttgtagattcgctcctggtcacccagtggctgctctctgtaccgtccattgtagcacgtgtgtagcccaaggcgtaagggccgtgatgatttgacgtcatcccccaccttcctcacag

SEQ ID NO: 367 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtcccgggaacgtattcaccgtatcattgctgatatacgattactagcgattccagcttcatgaggtcgagttgcagacctcaatctgaactgagataggatttttgagattagcatcctgttaccaggtagcagccctttgttcctaccattgtagccacgtgtgtagccctgggcataaaggccatgatgacttgacatcatcccctccttcctc

SEQ ID NO: 368 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales; Family: Flexibacteraceae
aaggcccgggaacgtattcaccgcgtcattgctgatacgcgattactagcgattccagcttcacgaagtcgagttgcagacttcgatccgaactgaggagcggctttttgaagattgggcatcctgtcaccaggtagcaaccctttgtaccgcccattgtagcacgtgtgtagccctaggcgtaagggccatgatgacctgacgtcatccccacttcctc

SEQ ID NO: 369 - DNA, 220 bp, Unknown
  Description of Unknown: 16S RNA Operational Taxonomic Unit polynucleotide
  Phylum: Actinobacteria; Class: Actinobacteria; Order: MC47
aaggcccgggaacatattcaccgcggcattgctgatccgcgattactagcaactccgccttcatggaggcgagtttcagcctccaatccgaaccgagaccgactttttgggattcgctccctctcacgagtttgcagccctttgtatcggccaatgtagcacgtgtgtagcccaggacataaggggcatgatgacttgacttcgaccccacttcccggat

SEQ ID NO: 370 - DNA, 220 bp, Unknown
  Description of Unknown: 16S RNA Operational Taxonomic Unit polynucleotide
  Phylum: Proteobacteria; Class: Alphaproteobacteria
aaggcccgggaacgtattcaccgcagcctgctgttctgcgattactagcgattccaccttcatgcacccgagttgcagagtgcaatctgaactgggacggtttttgggatcgcatccactcgcgtggtcgctgcccactgtcaccgccattgtagcacgtgtgtagcccaggccgtaagggccatgaggacttgacgtcatccccactcctccggcttgt

SEQ ID NO: 371 - DNA, 220 bp, Unknown
  Description of Unknown: 16S RNA Operational Taxonomic Unit polynucleotide
  Phylum: Acidobacteria; Class: Acidobacteria-5
aaggcccgggaacgtattcaccactgcttgctgatcagtgattactagcgattccagcttcatggagtcgagttgcagactccaatccgaactgagaccggcttttgagattggctccccctcgcgggtttgcgactctttgtaccggccattgtagtacgtgtgtagccctggacataaaggccatgaggacttgacgtcatccccaccttcctccggg

SEQ ID NO: 372 - DNA, 220 bp, Unknown
  Description of Unknown: 16S RNA Operational Taxonomic Unit polynucleotide
  Phylum: Proteobacteria; Class: Betaproteobacteria
aagacccgggaacggtattcaccgcgacatgctgatccgcgattactagcgattccgacttcatgcagtcgagttgcagactgcaatccggactacgacgcgctttaggggagttggctccagatcgctccttggcaaccctctgtacgcgccattgtattacgtgtgaagccctacccataagggccatgaggacttgacgtcatccccaccttcctcc

SEQ ID NO: 373 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Oxalobacteraceae
aagacccgggaacgtattcaccgcgacatgctgatccgcgattactagcgattccaacttcatgcagtcgagttgcagactgcaatccggactacgatacactttctgggattacgctcccccgtcgcgggttggcagccctctgtatgtaccattgtatgacgtgtgaagccctacccataagggccatgaggacttgacgtcatccccaccttcctcc

SEQ ID NO: 374 - DNA, 220 bp, Unknown
  Description of Unknown: 16S RNA Operational Taxonomic Unit polynucleotide
  Phylum: Proteobacteria; Class: Alphaproteobacteria; Order: Rhodospirillales; Family: Acetobacteraceae
acaaggcccgggaacgtattcaccgcggcgtgctgatccgcgattactagcgattccaccttcatgcacccgagttgcagagtgcaatctgaactgagacggcttttggggatcggctcggcctcgcgacctggcttcccactgtcaccgccattgtagcacgtgtgtagcccaggacataagggccatgaggacttgacgtcatccccacttcctccgg

SEQ ID NO: 375 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Geodermatophilaceae
aaggccggaacgtattcaccgcagcgttgctgatctgcgattactagcgactccaacttcatggggtcgagttgcagaccccaatccgaactgagaccggctttttgggattcgctccacctcacggtatcgcagccctttgtaccggccattgtagcatgtttgcagccctagacataaggggcatgatgatttgacgtcatccccacttcctccgagt

SEQ ID NO: 376 - DNA, 220 bp, Unknown
  Description of Unknown: 16S RNA Operational Taxonomic Unit polynucleotide
  Phylum: Chloroflexi; Class: Bljii12; Order: B07_WMSP1; Family: FFCH4570
aaggcccgggaacgtattcactgctgtgtgctgaccagcagttactagcaactccgacttcatgcaggcgagttgcagcctgcaatccgaactgagaccggctttggtgggatttgctccaggtcgcccttcgccgcccgttgtaccggccattgtagcgtgtgtgtagccctcggcgtaagagccgtgctgacttgacgtcatcccaccttcctccggt

SEQ ID NO: 377 - DNA, 220 bp, Unknown
  Description of Unknown: 16S RNA Operational Taxonomic Unit polynucleotide
  Phylum: Proteobacteria; Class: Betaproteobacteria
aagacccgggaacgtattcaccgcggcatgctgatccgcgattactagcgattccgacttcatgcagtcgagttgcagactgcaatccggactacgaacggcttttatggggattggctccccctcgcgggttggcaaccctctgtaccgtccattgtatgacgtgtgaagccctacccataagggccatgaggacttgacgtcatccccaccttcctcg

SEQ ID NO: 378 - DNA, 220 bp, Unknown
  Description of Unknown: 16S RNA Operational Taxonomic Unit polynucleotide
  Phylum: Proteobacteria; Class: Alphaproteobacteria; Order: Sphingomonadales; Family: Sphingomonadaceae
aaggcctgggaacgtattcaccgcggcatgctgatccgcgattactagcgattccgccttcatgctctcgagttgcagagaacaatccgaactgagacggcttttggagattaggctcaccctcgcgggtttgcagccctctgtcaccgccattgtagcacgtgtgtagcccagcgccgtaaggggccatgaggacttgacgtcatccccaccttcctcc

SEQ ID NO: 379 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales; Family: Flexibacteraceae
aaggtccgggaacgtattcaccgcgtcatagctgatacgcgattactagcgattccagcttcatagagtcgagttgcagactccaatccgaactgagaacggctttttgggattggcatcacctcgcagtgtagctaccctctgtaccgcccattgtagcacgtgtgttgccctggacgtaagggccatgatgacttgacgtcgtcccccttcctctcaa

SEQ ID NO: 380 - DNA, 220 bp, Unknown
  Description of Unknown: 16S RNA Operational Taxonomic Unit polynucleotide
  Phylum: Acidobacteria; Class: Solibacteres; Order: Solibacterales; Family: Solibacteraceae
aaggcccgggaacgtattcacggcagcgtgctgatctgccattactagcgattccagcttcatgcaggcgagttgcagcctgcaatccgaactgagaacggtttttgcgattggctccccctcgcgggtttgctgcgctttgtaccgtccattgtagcacgtgtgtagccctggacataaaggccatgaggacttgacgtcactccccaccttcctccaa

SEQ ID NO: 381 - DNA, 220 bp, Unknown
  Description of Unknown: 16S RNA Operational Taxonomic Unit polynucleotide
  Phylum: Proteobacteria; Class: Gammaproteobacteria; Order: Xanthomonadales; Family: Xanthomonadaceae
aagacccggacgtattcaccgcgacaagctgatccgcgattactagcgattccgacttcacgcagtcgagttgcagactgcgatccggactgagagaggttttctgggattggctccacctcgcggctttgcgaccctctgtacctcccattgtagtacgtgtgtagccctggtcgtaagggccatgatgacttgacgtcatccccaccttcctccggtt

SEQ ID NO: 382 - DNA, 220 bp, Unknown
  Description of Unknown: 16S RNA Operational Taxonomic Unit polynucleotide
  Phylum: Acidobacteria; Family: Koribacteraceae
aaggcccgggaacgtattcaccgcagcgtgctgatctgcgattactagcgattccagcttcatggagtcgagttgcagactccaatccgaactgaggatggcttttccgattgctccccctcgcgggtttgcgacggtttgtaccacccattgtagcacgtgtgtagccctggacataaaggccatgaggacttgacgtcatccccaccttcctccccgt

SEQ ID NO: 383 - DNA, 220 bp, Unknown
  Description of Unknown: 16S RNA Operational Taxonomic Unit polynucleotide
  Phylum: Acidobacteria; Class: Acidobacteria; Order: Acidobacteriales
aaggcccggaacgtattcaccgcggcgtgctgatccgcgattactagcgattccaacttcatgcaggcgagttgcagcctgcaatccgaactgagacagactttctccgattagctccaccttgcggtctcgcgacggtttgtatctgccattgtagcacgtgtgtagccccagacataaaggccatgctgacttgacgtcatccccaccttctccggtt

SEQ ID NO: 384 - DNA, 220 bp, Unknown
  Description of Unknown: 16S RNA Operational Taxonomic Unit polynucleotide
  Phylum: Proteobacteria; Class: Alphaproteobacteria; Order: Rhodospirillales; Family: Rhodospirillaceae
aaggcccgggaacgtattcaccgaggcatgctgatcctcgattactagcgattccaacttcatgcactcgagttgcagagtgcaatccgaactgagacggctttttaggattcggctcggctcgcgccatcgcatcccattgtcaccgccattgtagcacgtgtgtagcccagcccgtaagggccatgaggacttgacgtcatccccaccttcctccggc

SEQ ID NO: 385 - DNA, 220 bp, Unknown
  Description of Unknown: 16S RNA Operational Taxonomic Unit polynucleotide
  Phylum: Chloroflexi; Class: SOGA31
aaggcccgggaacgtattcaccgcagtgtgctgacctgcggttactagcaactccggcttcatgcaggcgagttgcagcctacaatccgaactgagaccggctttaagggattcgctccacctcgcggtttcgccgcccgttgtaccggccattgtagcgtgggtgtagcccaagacgtaagggccatgctgacttgacgtcatccccaccttcctccga

SEQ ID NO: 386 - DNA, 220 bp, Unknown
  Description of Unknown: 16S RNA Operational Taxonomic Unit polynucleotide
  Phylum: Acidobacteria; Class: Acidobacteria; Order: Acidobacteriales
aaggcccgggaacgtattcaccgcggcgtgctgatccgcgattactagcgattccaacttcacgcaggcgagttgcagcctacgatccgaactgagaccgactttctccgacttagcctccaccttgcggtatcgcgacggtttgtgtcggccattgtagcacgtgtgtggccccacgacataaaggccatgctgacttgacgtcatccccaccttcctc

SEQ ID NO: 387 - DNA, 220 bp, Unknown
  Description of Unknown: 16S RNA Operational Taxonomic Unit polynucleotide
  Phylum: Acidobacteria; Class: Chloracidobacteria
aggacccgggaacgtattcaccgcgacgttctgattcgcgattactagcgattccaacttcatggagtcgagttgcagactccaatccgaactgagaccggtttttgcgattagctccctcttacgagatcgcgacgttttgtaccggccattgtagcacgtgtgtagccctgaacataaaggccatgatgacttgacatcatccccaccttcctccgtt

SEQ ID NO: 388 - DNA, 220 bp, Unknown
  Description of Unknown: 16S RNA Operational Taxonomic Unit polynucleotide
  Phylum: Actinobacteria; Class: Actinobacteria; Order: MC47
aaggcccgggaacgtattcaccgcgacgttgctgattcgcgattactagcaactccgccttcatggaggcgagtttcagcctccaatccgaaccgggaccggctttttgggattcgctcactctcacgagtttgcagccctttgtaccggccaatgtagcacgtgtgtagcccaagacataaggggcatgatgacttgacgtcatccccaccttcctccg

SEQ ID NO: 389 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Bradyrhizobiaceae
aaggcccgggaacgtattcaccgtggcatgctgatccacgattactagcgattccaacttcatgggctcgagttgcagagcccaatccgaactgagacggctttttgagatttgcgaggggtcgcccctttggcatcccattgtcaccgccattgtagcacgtgtgtagcccagcccgtaagggccatgaggacttgacgtccatccccaccttcctcgc

SEQ ID NO: 390 - DNA, 220 bp, Unknown
  Description of Unknown: 16S RNA Operational Taxonomic Unit polynucleotide
  Phylum: Actinobacteria; Class: Actinobacteria; Order: MC47
aaggcccgggaacgaatattcaccgcggcattgctgatccgcgattactagcaactccgccttcatggaggcgagtttcagcctccaatccgaaccgggaccggctttttgggattcgctcactctcgcgagtttgcagccctttgtaccggccaatgtagcacgtgtgtagcccaagacataaggggcatgatgacttgacgtcatccccaccttccct

SEQ ID NO: 391 - DNA, 220 bp, Unknown
  Description of Unknown: 16S RNA Operational Taxonomic Unit polynucleotide
  Phylum: Verrucomicrobia; Class: Spartobacteria; Order: Spartobacteriales; Family: Spartobacteriaceae
aaggcccgggaacgtattcacggcgccgtagctgatgcgccattactagcgattccggcttcatggagtcgagttgcagactccaatccgaactgggcccagttttactagattacctccacctcgcggtctcggatcgttctgtactgggcattgtagtacgtgtgcagccctggccgtaagggccatactgacttgacgtcggtctccccaccttcct

SEQ ID NO: 392 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Oxalobacteraceae
aagacccgggaacgtattcaccgcggcatgctgatccgcgattactagcgattccaacttcacgtagtcgagttgcagactacgatccggactacgatacactttctgggatagctccccctcgcgggttggcggccctctgtatgtaccattgtatgacgtgtgaagccctaccccataaggggccatgaggacttgacgtcatccccaccttcctccg

SEQ ID NO: 393 - DNA, 220 bp, Unknown
  Description of Unknown: 16S RNA Operational Taxonomic Unit polynucleotide
  Phylum: Gemmatimonadetes; Class: Gemmatimonadetes; Order: Gemmatimonadales; Family: Gemmatimonadaceae
aaggccccgggaacgtattcaccgtggcgtagctgatccacgattactagcgattccagcttcatgccgtcgagttgcagacgacaatccgaactgaggcggggtttacgggattggcttgccgttgccggctcgcggccctctgtccccgccattgtagcacgtgtgtagccctagacgtaaggaccatgatgacttgacgtcatccccaccttcctcc

SEQ ID NO: 394 - DNA, 220 bp, Unknown
  Description of Unknown: 16S RNA Operational Taxonomic Unit polynucleotide
  Phylum: Cyanobacteria; Class: Oscillatoriophycideae
aaggccggaacgaatcgactgcagtatgctgacctgcaattactagcgattcctccttcacgcaggcgagttgcagcctgcgatctgaactgagccacggtttatgggattagcttgcgatcgctcgcttgctgccctttgtccgtcgcattgtagtacgtgtgtagcccaggacgtaaggggcatgctgacttgacgtcatccccacttcctccggttt

SEQ ID NO: 395 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatggagtcgagttgcagactccaatctgaactgagaggcgtttttgggtagttagcttcatatcgctatgttgcagccctttgtacgcccccacttgtagcacgtgtgtagccctgggcataaaggccatgatgacttgacatcatcccctccttcct

SEQ ID NO: 396 - DNA, 220 bp, Unknown
  Description of Unknown: 16S RNA Operational Taxonomic Unit polynucleotide
  Phylum: Proteobacteria; Class: Gammaproteobacteria; Order: Chromatiales; Family: Sinobacteraceae
gagacccgggaacgtattcaccgcgacgttgctgattcgcgattactagcgattccgacttcacggagtcgagttgcagactccgatccggactacgactggctttctgggattggctccccctcgcgggttggcagccctttgtaccagccattgtagcacgtgtgtagccctggtcataagggccatgatgacttgacgtcatccccaccttcctccg

SEQ ID NO: 397 - DNA, 220 bp, Unknown
  Description of Unknown: 16S RNA Operational Taxonomic Unit polynucleotide
  Phylum: Proteobacteria; Class: Gammaproteobacteria; Order: Xanthomonadales; Family: Xanthomonadaceae
aaggctcgggaacgtattcaccgcagcaatgctgatctgcgattactagcgattccgacttcatggagtcgagttgcagactccaatccggactgagaaaaggtttctgggattggctcaccctcgcgggatcgcagccctctgtccttcccattgtagtacgtgtgtagccctggccgtaagggccatgatgacttgacgtcatccccaccttcctccg

SEQ ID NO: 398 - DNA, 220 bp, Unknown
  Description of Unknown: 16S RNA Operational Taxonomic Unit polynucleotide
  Phylum: Acidobacteria; Class: Acidobacteria; Order: Acidobacteriales
aaggcccgggaacgtattcaccgcggcatgctgatccgcgattactagcgattccaacttcatgcaggcgagttgcagcctgcaatccgaactgagaccggctttctccgattggctcccctcgcgggattgcaacggtttgtaccggccattgtagcacgtgtgtagccccagacataaaggccatgctgacttgacgtcatccccaccttcctccggt

SEQ ID NO: 399 - DNA, 220 bp, Unknown
  Description of Unknown: 16S RNA Operational Taxonomic Unit polynucleotide
  Phylum: Proteobacteria; Class: Deltaproteobacteria; Order: Myxococcales; Family: Polyangiaceae
aaggcccgggaacgtattcacccctgcctgctgatcagggattactagcgattccaacttcaaagagtcgagttgcagactcttatctgtactgaggtcagtttttccgattggctccccctcacggttcgcgacggttgtgctgaccattgtagcacgtgtgtagccctggacataagggccatgatgacttgacgtcatccccaccttcctccgattt

SEQ ID NO: 400 - DNA, 220 bp, Unknown
  Description of Unknown: 16S RNA Operational Taxonomic Unit polynucleotide
  Phylum: Actinobacteria; Class: Actinobacteria; Order: MC47
aaggcccgggaacgtattcaccgcgacgttgctgattcgcgattactagcaactccgacttcatggaggcgagtttcagcctccaatccgaaccgggaccggctttttgggattcgctcccctcgcgggtttgcagccctttgtaccggccaatgtagcacgtgtgtagccctagacataagggtcatgctgacttgacgtcatccccaccttctccgat

SEQ ID NO: 401 - DNA, 220 bp, Unknown
  Description of Unknown: 16S RNA Operational Taxonomic Unit polynucleotide
  Phylum: Proteobacteria; Class: Betaproteobacteria
aagacccgggaacgtattcaccgcgacatgctgatccgcgattactagcgattccgacttcatgcagtcgagttgcagactgcaatccggactacgacgcgctttaagggattggctccaggtcgccccttggccaaccctcctgtacgcgccattgtattacgtgtgaagccctacccataagggccgatgaggacttgacgtcatccccaccttcctc

SEQ ID NO: 402 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatggagtcgagttgcagactccaatctgaactgagaggcgttttgggagttggcgtccttatcgctaagtggcagccctttgtacgccccacttgtagcacgtgtgtagccctgggcataaaggccatgatgacttgacatcatcccctccttcctcg

SEQ ID NO: 403 - DNA, 220 bp, Unknown
  Description of Unknown: 16S RNA Operational Taxonomic Unit polynucleotide
  Phylum: Bacteroidetes; Class: Flavobacteria; Order: Flavobacteriales; Family: Flavobacteriaceae
aaggccgggacgtattcaccggatcatggctgatatccgattactagcgattccagcttcacggagtcgagttgcagactccgatccgaactgtgaccggttttatagattcgctcctggtcgcccagtggctgctctctgtaccggccattgtagcacgtgtgtagcccaaggcgtaagggccgtgatgatttgacgtcatccccacttcctcacagtt

SEQ ID NO: 404 - DNA, 220 bp, Unknown
  Description of Unknown: 16S RNA Operational Taxonomic Unit polynucleotide
  Phylum: TM7; Class: TM7-3; Order: EW055
gagacccggacgtattcaccgcaacttgctgatttgcgattactagcgattccgacttcatggaggcgagtttcagcctccaatccgaactgggactagctttggtgcgatttgctccacctcgcggcttcgctgcgcattgtactagccattgtatcgtgtttctagcccaggacgtaagggaaatactgacctgacatcatcccctccttcctccccg

SEQ ID NO: 405 - DNA, 220 bp, Unknown
  Description of Unknown: 16S RNA Operational Taxonomic Unit polynucleotide
  Phylum: Acidobacteria; Family: Koribacteraceae
aaggcccgggaacgtattcaccgcagcgtgctgatctgcgattactagcgattccagcttcatggagtcgagttgcagactccaatccggatgggattggctttttccgattagctcccctcgcggtttgcgacggtttgtaccaaccattgtagcacgtgtgtagccctggacataaaggccatgaggacttgacgtcatccccaccttcctccccgta

SEQ ID NO: 406 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aaggcccgggaacgtattcaccgcagcactgctgatctgcgattactagcgactccgacttcatggggtcgagttgcacgacccccaatccgaactgagaccggctttttgagattcgctccacctcgcggtatcgcagctcattgtaccggccattgtagcacgtgtgcagcccaagacataaggggcatgatgacttgacgtcgtccccaccttccta

SEQ ID NO: 407 - DNA, 220 bp, Unknown
  Description of Unknown: 16S RNA Operational Taxonomic Unit polynucleotide
  Phylum: Acidobacteria; Class: Solibacteres; Order: Solibacterales; Family: Solibacteraceae
aaggcccgggaacgtattcacggcggcgttctgatccgccattactagcgattccagcttcatgcaggcgagttgcagcctgcaatccgaactgagaacggttttttgcgatttgctccccctcgcgggttggcggcgctttgtaccgtccattgtagcacgtgtgtagccctggacataaaggccatgatgacttgacgtcatccccaccttcctccaa

SEQ ID NO: 408 - DNA, 220 bp, Unknown
  Description of Unknown: 16S RNA Operational Taxonomic Unit polynucleotide
  Phylum: Actinobacteria; Class: Actinobacteria; Order: Actinomycetales
aaggcccgggaacgtattcaccgcagcgttgctgatctgcgattactagcgactccgacttcatggggtcgagttgcagaccccaatccgaactgagaccggctttttgggtattcgctccaccttgcggtatcgcagccctttgtaccggccattgtagcatgcttgaagccctggaccataaggggcaatgatgatttgacgtcatcccaccttcctc

SEQ ID NO: 409 - DNA, 220 bp, Unknown
  Description of Unknown: 16S RNA Operational Taxonomic Unit polynucleotide
  Phylum: Firmicutes; Class: Bacilli; Order: Bacillales; Family: Sporolactobacillaceae
aaggcccgggaacgtattcaccgcggcatgctgatccgcgattactagcgattccggcttcatgcaggcgggttgcagcctgcaatccgaactgggaatggtttctgggattggcttaacctcgcggtctcgcagccctttgtaccatccattgtagcacgtgtgtagcccaggtcataaggggcatgatgatttgacgtcatccccaccttcctccggt

SEQ ID NO: 410 - DNA, 220 bp, Unknown
  Description of Unknown: 16S RNA Operational Taxonomic Unit polynucleotide
  Phylum: Firmicutes; Class: Bacilli; Order: Bacillales; Family: Bacillaceae
aaggcccgggaacgtattcaccgcggcatgctgatccgcgattactagcgattccggcttcatgtaggcgagttgcagcctacaatccgaactgagaatggctttatgagattagctagccctcgcgggtttgcgactctttgtaccatccattgtagcacgtgtgtagcccaggtcataaggggcatgatgatttgacgtcatccccactctccggtcg

SEQ ID NO: 411 - DNA, 220 bp, Unknown
  Description of Unknown: 16S RNA Operational Taxonomic Unit polynucleotide
  Phylum: Chloroflexi; Class: SOGA31
aaggcccgggaacatattcaccgccgtatgctgaccggcggttactagcaactccggcttcatgtaggcgagttgcagcctacaatccgaactgagaccggcttttaagggatcgctccacctcgcggtttcgcagcccgttgtaccggccattgtagcgtgggtgtagccccaggacgtaagggccatgctgacttgacgtcatccccaccttctccga

SEQ ID NO: 412 - DNA, 220 bp, Unknown
  Description of Unknown: 16S RNA Operational Taxonomic Unit polynucleotide
  Phylum: Actinobacteria; Class: Actinobacteria; Order: MC47
acaaggcccgggaacatattcaccgcggcgttgctgatccgcgattactagcaactccgccttcatggaggcgagtttcagcctccaatccgaaccgggaccggctttttgggattcgctcaccctcgcaggtttgcagccctttgtaccggccaatgtagcacgtttgtagcccaggacataaggggcatgatgacttgacctcatccccacttcctcc

SEQ ID NO: 413 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales; Family: Flexibacteraceae
aaggcccaggaacgtattcaccgcgtcattgctgatacgcgattactagcgattccagcttcacgaagtcgagttgcagacttcgatccgaactgagagcggcttttgagattggcatcctgtcaccaggtagcaaccctctgtaccgcccattgtagcacgtgtgtagccctaggcgtaagggccatgatgacctgacgtcatccccaccttcctcact

SEQ ID NO: 414 - DNA, 220 bp, Unknown
  Description of Unknown: 16S RNA Operational Taxonomic Unit polynucleotide
  Phylum: Gemmatimonadetes; Class: Gemmatimonadetes
aaggtccgggaacgtattcaccgtggtgtagctgacccacgattactagcgattccggcttcatgcagtcgagttacagactgcaatccgaacttggaccaggtttttgcgattcgctccgcctcgcggcctcgctgcgctttgtcctggccattgtagcacgtgtgtagccctgggcgtaaggaccatgatgacttgacgtcgtccccaccttcctccg

SEQ ID NO: 415 - DNA, 220 bp, Unknown
  Description of Unknown: 16S RNA Operational Taxonomic Unit polynucleotide
  Phylum: TM7; Class: TM7-1
aaagacccgggaacgtattcacggtagtatagctgacctaccgttactagcgattccgacttcaagcaggcgagtttcagcctgctatccgaactgggaccggctttgatgggatttgctccgtctcgcgacttggctgccctttgtaccggccattgtagcgtgtttgtagccccagacgtaagggaatactgacctgacatcatcccctcttcctccc

SEQ ID NO: 416 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Oxalobacteraceae
aagacccgggaacgtattcaccgcggcatgctgatccgcgattactagcgattccaacttcacgcagtcgagttgcagactgcgatccggactacgatgcactttctgggatttgctccccctcgcggtggcagccctctgtatgcaccattgtatgacgtgtgaagccctacccataagggccatgaggacttgacgtcactccccaccttcctccggt

SEQ ID NO: 417 - DNA, 220 bp, Unknown
  Description of Unknown: 16S RNA Operational Taxonomic Unit polynucleotide
  Phylum: Proteobacteria; Class: Alphaproteobacteria; Order: Sphingomonadales; Family: Sphingomonadaceae
acaaggcctgggaacgtattcaccgcggcatgctgatccgcgattactagcgattccgccttcatgctctcgagttgcagagaacaatccgaactgagacggctttttgggattagcttcccctcgcgaggtagcagcccgttgtcaccgccattgtagcacgtgtgtagcccagcgcgtaagggccatgaggacttgacgtcatccccaccttcctccg

SEQ ID NO: 418 - DNA, 220 bp, Unknown
  Description of Unknown: 16S RNA Operational Taxonomic Unit polynucleotide
  Phylum: Proteobacteria; Class: Alphaproteobacteria; Order: Sphingomonadales
aaggcctgggaacgtattcaccgcggcatgctgatccgcgattactagcgattccgccttcatgctctcgagttgcagagaacaatccgaactgagacggcttttggagattagctcaccctcgcggggtcggctgctcactgtcaccgcccattgttagcacgtgtgtagcccagcgcgtaagggccatgaggacttgacgtcatccccaccttcctcc

SEQ ID NO: 419 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales; Family: Flexibacteraceae
aaggccgggaacgtattcaccgcgtcattgctgatacgcgattactagtgattccagcttcacggagtcgagttgcagactccgatccgaactgagaacggcttttcgggattggcgcaccatcgctggttggcaacccgctgtaccgtccattgtagcacgtgtgtagccctaggcgtaagggccatgatgacctgacgtcgtccccgccttcctcact

SEQ ID NO: 420 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Sanguibacteraceae
aaggcccgggaacgtattcaccgcagcgttgctgatctgcgattactagcgactccgacttcatggggtcgagttgcagaccccaatccgaactgagaccggctttttgggtattcgctccacctcgcggtatcgcagccctttgttaccggcccattgtagcatgcgtgaagcccaagacataaggggcatgatgatttgacgtcatcccaccttcctc

SEQ ID NO: 421 - DNA, 220 bp, Unknown
  Description of Unknown: 16S RNA Operational Taxonomic Unit polynucleotide
  Phylum: Gemmatimonadetes; Class: Gemmatimonadetes; Order: Gemmatimonadales; Family: Gemmatimonadaceae
gaaggcccgggaacgtattcaccgtggcgatgctgatccacggattactagcgattccagcttcatgccgtcgagttgcagacgacaatccgaactgaggaccggttttgggattgccttggcattgctgcctcggcccccactgtccgacccattgtagcacgtgtgtagccctagacgtaaggaccatgatgacttgacgtcgtccccacttcctccg

SEQ ID NO: 422 - DNA, 220 bp, Unknown
  Description of Unknown: 16S RNA Operational Taxonomic Unit polynucleotide
  Phylum: Actinobacteria; Class: Actinobacteria; Order: Solirubrobacterales; Family: Solirubrobacteraceae
aaggcccgggaacgtattcaccgcggcaatgctgatccgcgattactagcaactccgccttcatgcaggcgggtttcagcctgcaatccgaaccgagacacgctttgagggattcgctccacctcacggtatcgcagccctctgtacgtgccaatgtagcacgtgtgtagccctggacataaggggcatgatgacttgacgtcatccccaccttctccgt

SEQ ID NO: 423 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggacggtattcaccgtatcattgctgatatacgattactagcgattccagcttcatggagtcgagttgcagactccaatctgaactgagaaagagttttgtagattagcgccttgtcaccaagtggcagctctttgtctcttcccattgtagcacgtgtgtagcccctgggcataaaggccatgatgacttgacatcatccccctccttcct

SEQ ID NO: 424 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccggaacgtattcgaccgtagcgttgctgatctacgattactagcgattccagcttcatgcaggcgagttgcagcctgcaatctgaactgagaggggattttgagattggcatcctgtcaccaggtagcagccctttgttccccccattgtagcacgtgtgtagccctgggcataaaggccatgatgacttgacatcatcccctccttcctcacg

SEQ ID NO: 425 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtagcgttgctgatctacgattactagcgattccagcttcatggagtcgagttgcagactccaatctgaactgagagggcgttttttgggattagcttcatatcgctatgttgcagtccctttgtacgcccattgtagcacgtgtgtagccctgggcataaaggccatgatgacttgacatcatcccccttcctcacg

SEQ ID NO: 426 - DNA, 220 bp, Unknown
  Description of Unknown: 16S RNA Operational Taxonomic Unit polynucleotide
  Phylum: Verrucomicrobia; Class: Spartobacteria; Order: Spartobacteriales; Family: Spartobacteriaceae
aaggcccgggaacgtattcacggcgtcgtagctgatacgccattactagcgattccggcttcatggagtcgagttgcagactccaatccgaactgggctcagttttactggattcctccacctcgcggtctcggatcgttctgtactgagcattgtagtacgtgtgcagccctggccgtaagggccatactgacttgacgtcgtcccccaccttcctccc

SEQ ID NO: 427 - DNA, 220 bp, Unknown
  Description of Unknown: 16S RNA Operational Taxonomic Unit polynucleotide
  Phylum: Verrucomicrobia; Class: Spartobacteria; Order: Spartobacteriales; Family: Spartobacteriaceae
aaggccggacgtatcgacggcgccgtagctgatgcgccattactagcgattccggcttcatggagtcgagttgcagactccaatctgaactgggcccagttttagagatttcctccaccttgcggtctcggatcgttctgtgctgggcattgtagtacgtgtgcagcccaggccgtaagggccatactgacttgacgtcgtccccaccttcctccccgtt

SEQ ID NO: 428 - DNA, 220 bp, Unknown
  Description of Unknown: 16S RNA Operational Taxonomic Unit polynucleotide
  Phylum: Proteobacteria; Class: Alphaproteobacteria
aaggcccgggaacgtattcaccgcagcctgctgttctgcgattactagcgattccaccttcatgcactcgagttgcagagtgcaatctgaactgggacggtttttgggattagccgctcgtcgccgagtagcagcccactgtcaccgccattgtagcacgtgtgtagcccagggtgtaagggccatgaggacttgacgtcatccccaccttcctccggct

SEQ ID NO: 429 - DNA, 220 bp, Unknown
  Description of Unknown: 16S RNA Operational Taxonomic Unit polynucleotide
  Phylum: Proteobacteria; Class: Gammaproteobacteria; Order: Xanthomonadales; Family: Xanthomonadaceae
aaggcccgggaacgtattcaccgcagcaatgctgatctgcgattactagcgattccgacttcatggagtcgagttgcagactccaatccggactgggatagggtttctgggattggctcaccctcgcgggattgcggccctctgtccctaccattgtagtacgtgtgtagccctggccgtaaggccatgatgacttgacgtcatccccacttcctccggc

SEQ ID NO: 430 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatggagtcgagttgcagactccaatctgaacttgagaggcgttttttgggattggctccttatcgctaagtggcagccctttgtacgccccattgtagcacgtgtgtagccctgggcataaaggcccatggatgacttgacatcatcccctccttcct

SEQ ID NO: 431 - DNA, 220 bp, Unknown
  Description of Unknown: 16S RNA Operational Taxonomic Unit polynucleotide
  Phylum: Gemmatimonadetes; Class: Gemmatimonadetes; Order: Gemmatimonadales; Family: Gemmatimonadaceae
aaggcccgggaacgtattcaccgtggcgtagctgatccacgattactagcgattccagcttcatggaggcgagttgcagcctccaatccgcactgagatcggcttttgggattggctcccctcgcggtttgcagccctctgtaccgatcattgtagcacgtgtgtagccctagacgtaaggaccatgatgacttgacgtcgtccccaccttctccgggtt

SEQ ID NO: 432 - DNA, 220 bp, Unknown
  Description of Unknown: 16S RNA Operational Taxonomic Unit polynucleotide
  Phylum: Proteobacteria; Class: Deltaproteobacteria; Order: Myxococcales; Family: Haliangiaceae
aaggcccgggaacgtattcacccctgcctgctgatcagggattactagcgattccgacttcatgaagtcgagttgcagacttcaatctgaactgaggccggttttttgggattggcttgccctcgcgggtttgcgaccctttgtaccggtcattgtagcacgtgtgtagccctgggcataagggccatgaggacttgacgtcatccccaccttcctccgt

SEQ ID NO: 433 - DNA, 220 bp, Unknown
  Description of Unknown: 16S RNA Operational Taxonomic Unit polynucleotide
  Phylum: Armatimonadetes; Class: Chthonomonadetes; Order: Chthonomonadales; Family: Chthonomonadaceae
aaggcccgggaacgtattcactgccgcttatctgatcggcaattactagcgattccgacttcacgcaggcgagttgcagcctgcgatctgaactgggaacggatttttgtagattgcctccacctcgcggtctcggatccctttgtctaccgtccattgtagcatgttttgtagcccagggcgtaagggccatgctgacttgacgtcgtcctcaccttcc

SEQ ID NO: 434 - DNA, 220 bp, Unknown
  Description of Unknown: 16S RNA Operational Taxonomic Unit polynucleotide
  Phylum: Firmicutes; Class: Bacilli; Order: Bacillales; Family: Alicyclobacillaceae
aaggcccgggaacgtattcaccgcgtcattgctgatacgcgattactagcaattccggcttcatgcaggcgagttgcagcctgcaatccgaactacgaacggctttatgagattggctccacctcgcggtctcgcgtctctttgtaccgcccattgtagcacgtgtgtagcccaagacataaggggcatgatgatttgacgtcatccccgccttcctccg

SEQ ID NO: 435 - DNA, 220 bp, Unknown
  Description of Unknown: 16S RNA Operational Taxonomic Unit polynucleotide
  Phylum: Verrucomicrobia
aaggcccgggaacgtattcacgccgtcgtagctgatacggcattactagcgattccagcttcatgcaggcgagttgcagcctgcaatctgaactgagcccagttttttgggatttccttgccgtcgccggcttggttcctctgtactgggcattgtagtacgtgtgcagccctaggcgtaagggccatgctgacttgacgtcatccccacttcctccccg

SEQ ID NO: 436 - DNA, 220 bp, Unknown
  Description of Unknown: 16S RNA Operational Taxonomic Unit polynucleotide
  Phylum: Proteobacteria; Class: Alphaproteobacteria; Order: Caulobacterales; Family: Caulobacteraceae
aaggcccgggaacgtattcaccgcggcatgctgatccgcgattactagcgattccgacttcatgcactcgagttgcagagtgcaatccgaactgagacgacttttaggattagctcccctcgcaggtttgcagccctctgtagtcgccattgtagcacgtgtgtagcccacccgtaagggccatgaggacttgacgtcatccccaccttcctccggctta

SEQ ID NO: 437 - DNA, 220 bp, Unknown
  Description of Unknown: 16S RNA Operational Taxonomic Unit polynucleotide
  Phylum: Bacteroidetes; Class: Flavobacteria; Order: Flavobacteriales; Family: Flavobacteriaceae
aaggcccgggaacgtattcaccggatcatggctgatatccgattactagcgattccagcttcacggagtcgagttgcagactccgatccgaactgtgaccggctttgtagattcgctcctggtcacccagtggctgctctctgtaccggccattgtagcacgtgtgtagcccaaggcgtaagggccgtgatgatttgacgtcatccccttcctcacagtg

SEQ ID NO: 438 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
acaaggtccgggaacgtattcaccgtatcattgctgatatacgattactagcgattccagcttcatgaggtcgagttgcagacctcaattcgaactgagacgagttttttgagattagcatcctgttaccaggtagcaaccctttgtactcgccattgtagcacgtgtgtagccctgggcataaaggccatgatgacttgacatcatcccctccttcctc

SEQ ID NO: 439 - DNA, 220 bp, Unknown
  Description of Unknown: 16S RNA Operational Taxonomic Unit polynucleotide
  Phylum: Proteobacteria; Class: Alphaproteobacteria; Order: Caulobacterales; Family: Caulobacteraceae
aaggcccgggaacgtattcaccgcggcatgctgatccgcgattactagcgattccaacttcacgccctcgagttgcagaggacgatccgaactgagacgacttttagggatttaccctctgtagtcgccattgtagcacgtgtgtagcccaccccgtaagggccatgaggacttgacgtcatccccaccttcctctcggcttagcaccggcagtccctct

SEQ ID NO: 440 - DNA, 220 bp, Unknown
  Description of Unknown: 16S RNA Operational Taxonomic Unit polynucleotide
  Phylum: Proteobacteria; Class: Gammaproteobacteria; Order: Chromatiales; Family: Sinobacteraceae
aaagacccgggaacgtattcaccgcagcaatgctgatctgcgattactagcgattccgacttcatggagtcgagttgcagactccaatccggactacgacaagttttctgggattagctcccgtcgccggttggcttccctctgtacttgccattgtagcacgtgtgtagccctgtcataaaggccatgatgacttgacgtcatccccacttcctccggt

SEQ ID NO: 441 - DNA, 220 bp, Unknown
  Description of Unknown: 16S RNA Operational Taxonomic Unit polynucleotide
  Phylum: Firmicutes; Class: Bacilli; Order: Bacillales; Family: Alicyclobacillaceae
aaggcccgggaacgaattcaccgcggcatgctgatccgcgattactagcaattccggcttcatgcaggcgagttgcagcctgcaatccgaactacgaacggctttctgggattggcttcacctcgcggcttcgctaaccctttgtaccgtccattgtagcacgtgtgtagcccaggacagtaaggggcatgatgatttgacgtcatccccgcctttcctc

SEQ ID NO: 442 - DNA, 220 bp, Unknown
  Description of Unknown: 16S RNA Operational Taxonomic Unit polynucleotide
  Phylum: Acidobacteria; Class: Chloracidobacteria
aagatccgggaacgtattcaccgcaacatgctgatttgcgattactagcgattccaacttcatgaagtcgagttgcagacttcaatccgaactgagaccggtttttgcgattagctccctcttgcgagattgcgacgttttgtaccggccattgtagcacgtgtgtagccctgaacataaaggccatgatgacttgacatcatccccaccttcctccgtt

SEQ ID NO: 443 - DNA, 220 bp, Unknown
  Description of Unknown: 16S RNA Operational Taxonomic Unit polynucleotide
  Phylum: Chloroflexi; Class: SOGA31
aagcccggaacatattcaccgccgtatgctgaccggcggttactagcaactccggcttcatgcaggcgagttgcagcctacaatccgaactgagaccggctttaagggatttgctccacctcgcggtttcgccgcccgttgtaccggccattgtagcgtgggtgtagcccaggacgtaagggccatgctgacttgacgtcatccccgccttcctccgagt

SEQ ID NO: 444 - DNA, 220 bp, Unknown
  Description of Unknown: 16S RNA Operational Taxonomic Unit polynucleotide
  Phylum: Actinobacteria; Class: Actinobacteria; Order: MC47
aaggcccgggaacgtattcaccgcggcaatgctgatccgcgattactagcaactccgccttcatggaggcgagtttcagcctccaatccgaaccgggaccggctttttgggattcgctcccccctcacgggtttgcagcctttgtaccggccaatgtagcacgtgtgtagccctagacataaggggcatgatgacttgacgtcatccccaccttcctccc

SEQ ID NO: 445 - DNA, 220 bp, Unknown
  Description of Unknown: 16S RNA Operational Taxonomic Unit polynucleotide
  Phylum: Actinobacteria; Class: Actinobacteria; Order: MC47
aggacccgggaacatattcaccgcggcattgctgatccgcgattactagcaactccgccttcatggaggcgagtttcagcctccaatccgaaccgagaccgactttttgggattcgctccgcctcgcggcatcgcagccctctgtatcggccaatgtagcacgtgtgtagcccaggacataaggggcatgatgacttgacttcgaccccaccttcctccg

SEQ ID NO: 446 - DNA, 220 bp, Unknown
  Description of Unknown: 16S RNA Operational Taxonomic Unit polynucleotide
  Phylum: Armatimonadetes; Class: CH21
aagacccgggaacgtattcaacgcagtatagctgacctgcgtttactagcgattccgccttcatgcagtcgagttgcagactgcaatctgaactggggcgtatttggatttgctccactcgcggtattgctgcccattgtttcgcccattgtagcatgtgtgaagccccaggcgtaactgccatgctgacttgacgtcatcctcaccttcctccggctta

SEQ ID NO: 447 - DNA, 220 bp, Unknown
  Description of Unknown: 16S RNA Operational Taxonomic Unit polynucleotide
  Phylum: Proteobacteria; Class: Alphaproteobacteria; Order: Sphingomonadales; Family: Sphingomonadaceae
aaggcctgggaacgtattcaccgcggcgtgctgatccgcgattactagcgattccgccttcatgctctcgagttgcagagaacaatccgaactgagacggcttttttgggatttgctcactctcgcgagttttgctgcccgttgtcaccgccatttgtagcacgtgtgtagcccagcgcgtaagggccatgaggacttgacgtcatccccaccttcctcg

SEQ ID NO: 448 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Hyphomicrobiaceae
aaggcccggaacgtattcgaccgcagcgtgctgatctgcgattactagcgattccgacttcatggggtcgagttgcagaccccaatccgaactgagacggcttttttgagatttgcgcaggattgctccattgcgtcccactgtcaccgccattgtagcacgtgtgtagcccagcccgtaagggccatgaggacttgacgtcatccccacttcctcgcgg

SEQ ID NO: 449 - DNA, 220 bp, Unknown
  Description of Unknown: 16S RNA Operational Taxonomic Unit polynucleotide
  Phylum: Acidobacteria; Class: Chloracidobacteria
aagacccgggaacgtattcaccgcagcatgctgatctgcgattactagcgattccagcttcatggagtcgagttgcagactccaatccgaactgagacaagctttttccgattggctccccattgctggtttgcagcggtttgtacttgccattgtagcacgtgtgtagccctggacataaaggccatgaggacttgacgtacactcccccaccttcctt

SEQ ID NO: 450 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Hyphomicrobiaceae
aaaggcccggggaacgtattcaccgcagcgtgctgatctgcgattactagcgattccaacttcatggggtcgagttgcagaccccaatccgaactgagacggattttttgagatttgcgaagggtcgcccctttgcatccctctgtcaccgccattgtagcacgtgtgtagcccagcccgtaagggccatgaggacttgacgtcatccccaccttcctcc

SEQ ID NO: 451 - DNA, 220 bp, Unknown
  Description of Unknown: 16S RNA Operational Taxonomic Unit polynucleotide
  Phylum: Acidobacteria; Class: Acidobacteria; Order: Acidobacteriales
aaggcccgggaacgtattcaccgcggcgtgctgatccgcgattactagcgattccaacttcatgcaggcgagttgcagcctgcaatccgaactgagacagactttctccgattagctccaccttgcggtctcgcgacggtttgtatctgccattgtagcacgtgtgtagccccagacataaaggccatgcctgaacttgacgtcatccccacttcctccg

SEQ ID NO: 452 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales; Family: Flexibacteraceae
aaggtccgggaacgtattcaccgcgccattgctgatgcgcgattactagcgattccaacttcatgcaggcgagttgcagcctgcaatccgaactgagacatccttttgtgattggctttccatcgctggatcgcaacactctgtagatgccattgtagcacgtgtgtagccctgggcgtaagggccatgatgacttgacgtcatcccctccttcctctcc

SEQ ID NO: 453 - DNA, 220 bp, Unknown
  Description of Unknown: 16S RNA Operational Taxonomic Unit polynucleotide
  Phylum: Verrucomicrobia; Class: Spartobacteria; Order: Spartobacteriales; Family: Spartobacteriaceae
aaggcccgggaacgtattcacggcgccgtagctgatgcgccattactagcgattccggcttcatggagtcgagttgcagactccaatccgaactgggctcagttttactagattcctccacctcgcggtctcggatcgttctgtactgagcattgtagtacgtgtgcagcccaggccgtaagggccatactgacttgacgtcgtcccacttcctcccgtt

SEQ ID NO: 454 - DNA, 220 bp, Unknown
  Description of Unknown: 16S RNA Operational Taxonomic Unit polynucleotide
  Phylum: Actinobacteria; Class: Actinobacteria; Order: Solirubrobacterales; Family: Patulibacteraceae
aagacccgggaacgtattcaccgcggcaatgctgatccgcgattactagcaactccaccttcatgcaggcgggtttcagcctgcaatccgaaccgagacgcgctttgagggattcgctccacctcgcggtatcgcagccctctgtacgcgccaatgtagcacgtgtgtagccctgggcataaggggcatgatgacttgacgtcatccccaccttcctcac

SEQ ID NO: 455 - DNA, 220 bp, Unknown
  Description of Unknown: 16S RNA Operational Taxonomic Unit polynucleotide
  Phylum: Acidobacteria; Class: iii1-8; Order: DS-18
aaggcccgggaacgtattcaccgcggcgtgctgatccgcgattactagcgattccagcttcatgcagtcgagttgcagactgcaatccgaactgagaacggcttatgagattagctccacctcgcggttttgcgactctttgtaccgtccattgtagcacgtgtgtagcccggacataaaggccatgaggacttgacgtcatccccactcctccggttat

SEQ ID NO: 456 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Pseudonocardiaceae
aaggcccgggaacgtattcaccgcagcgttgctgatctgcgattactagcgactccgacttcacgcagtcgagttgcagactgcgatccgaactagaccggcttaagggatcgctccacctcgcggtatcgcagccctctgtaccagccattgtagcatgtgtgaagccctggacataaggggcatgatgacttgacgtcatccccaccttcctccgagt

SEQ ID NO: 457 - DNA, 220 bp, Unknown
  Description of Unknown: 16S RNA Operational Taxonomic Unit polynucleotide
  Phylum: Gemmatimonadetes; Class: Gemmatimonadetes; Order: Gemmatimonadales; Family: Gemmatimonadaceae
aagacccgggaacgtattcaccgtggcgtagctgatccacgattactagcgattccagcttcatggaggcgagttgcagcctccaatccgcactgaggtcggctttatgggattggcttgccatcgctggctcgcaaccctttgtaccggccattgtagcacgtgtgtagccctagacgtaaggaccatgatgacttgacgtcgtccccaccttcctccg

SEQ ID NO: 458 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Microbacteriaceae
aaggcccggaacgtattcaccgcagcgttgctgatctgcgattactagcgactccgacttcatgaggtcgagttgcagacctcaatccgaactgagaccggcttttgggattcgctccaccttacggtattgcagccctttgtaccggccattgtagcatgcgtgaagcccaagacataaggggcatgatgatttgacgtcatcccaccttcctccgagt

SEQ ID NO: 459 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Hyphomicrobiaceae
aaggcccgggaacgtattcaccgcagcgtgctgatctgcgattactagcgattccaacttcatggggtcgagttgcagaccccaatccgaactgagacggctttttgagattgcgaaggattgctcccttgcatccctctgtcaccgccattgtagcacgtgtgtagcccagcccgtaagggccatgaggacttgacgtcatccccaccttcctccggct

SEQ ID NO: 460 - DNA, 220 bp, Unknown
  Description of Unknown: 16S RNA Operational Taxonomic Unit polynucleotide
  Phylum: Verrucomicrobia; Class: Verrucomicrobiae; Order: Verrucomicrobiales
aaggcctgggaacgtattcacggcgccgtagctgatgcgccattactagcgattccaacttcatgccgtcgagttgcagacggcaatctgaactgggcccaatttctgggatttgctcacctgacggtcttgcttccctttgtgttgggcattgtagtacgtgtgcagccctggccgtaagggccatactgacttgacgtcatcccacttcctcccgtta

SEQ ID NO: 461 - DNA, 220 bp, Unknown
  Description of Unknown: 16S RNA Operational Taxonomic Unit polynucleotide
  Phylum: Actinobacteria; Class: Actinobacteria; Order: MC47
aaggcccgggaacgtattcaccgcggcgttgctgatccgcgattactagcaactccgccttcatggaggcgagttgcagcctccaatccgaaccgggaccggcttttgggattcgctcaacctcacggtattgcagccctttgtaccggccaatgtagcacgtgtgtagcccaagacttaaggggcatgatgacttgacatcatccccaccttccccgac

SEQ ID NO: 462 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccggaacgtattcaccgtatcattgctgatatacgattactagcgattccagcttcacgcagtcgagttgcagactgcgatctgaactgagagagggtttttagattggctccttatcgctaagtggcagctcttgtcctcccattgtagcacgtgtgtagccctgggcataaaggccatgatgacttgacatcatcccctccttcctcgcgtct

SEQ ID NO: 463 - DNA, 220 bp, Unknown
  Description of Unknown: 16S RNA Operational Taxonomic Unit polynucleotide
  Phylum: Proteobacteria; Class: Betaproteobacteria
aagacccgggaacgtattcaccgcgacatgctgatccgcgattactagcgattccgacttcatggagtcgagttgcagactccaatccggactacgacgcgctttgtgggattggctccacctcgcggcttggcaaccctctgtacgcgccattgtattacgtgtgaagcccctaccataaagggccatgaggacttgacgtcatccccaccttcccccc

SEQ ID NO: 464 - DNA, 220 bp, Unknown
  Description of Unknown: 16S RNA Operational Taxonomic Unit polynucleotide
  Phylum: Actinobacteria; Class: Actinobacteria; Order: Actinomycetales
aaggacccgggaacgtattcaccgcagcgttgctgatctgcgattactagcgactccgacttcatggggtcgagttgcagaccccaatccgaactgagaccggctttttgggattcgctccaccttgcggtatcgcagccctttgtaccggccattgtagcatgcgtgaagccctaggcataaggggcatgatgacttgacgtcatccccacttcctccg

SEQ ID NO: 465 - DNA, 220 bp, Unknown
  Description of Unknown: 16S RNA Operational Taxonomic Unit polynucleotide
  Phylum: Verrucomicrobia; Class: Verrucomicrobiae; Order: Verrucomicrobiales; Family: Verrucomicrobia subdivision 3
aaggcctgggaacgtattcacggcgccgtagctgatgcgccattactagcgattccaacttcatgccgtcgagttgcagacggcaatctgaactgggcccggttttctggatttgctccacctgacggtcttgcttccctttgtaccgggcattgtagtacgtgtgcagccctggcccgtaagggcccatactgacttgacgtcatccccacttcctcct

SEQ ID NO: 466 - DNA, 220 bp, Unknown
  Description of Unknown: 16S RNA Operational Taxonomic Unit polynucleotide
  Phylum: Actinobacteria; Class: Actinobacteria; Order: Actinomycetales
aaggcccgggaacgtattcaccgcagcattgctgatctgcattactagcgactccgacttcacggggtcgagttgcagaccccgatccgaactgagaccggctttgtgggattcgctccacctcacggcttcgcagccctctgtaccggccattgtagcatgtgtgaagccctggacataaggggcatgatgacttgacgtcgtccccaccttctccgag

SEQ ID NO: 467 - DNA, 220 bp, Unknown
  Description of Unknown: 16S RNA Operational Taxonomic Unit polynucleotide
  Phylum: WS3; Class: PRR-12; Order: Sediment-1; Family: PRR-10
aaggcccgggaacgtattcaccgctgcctgctgatcagcgattactagcgattccgacttcatgcagtcgagttgcagactgcaatccgaactgagaccggttttttgggattggctccacctcgcggtatcgcagccctttgtaccggccattgtagcacgtgtgtagccccagacgtaagggccatgaggacttgacgtcatccccaccttcctccgc

SEQ ID NO: 468 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatgcaggcgagttgcagcctgcaatctgaactgagagacgtttttgggattagcttcacatcgctgtgttgcagccctttgtacgcccattgtagcacgtgtgtagccctgggcataaggccatgatgacttgacatcatcccccttcctcgcgtctt

SEQ ID NO: 469 - DNA, 220 bp, Unknown
  Description of Unknown: 16S RNA Operational Taxonomic Unit polynucleotide
  Phylum: Firmicutes; Class: Bacilli; Order: Bacillales; Family: Alicyclobacillaceae
aaggccagggaacgaattcaccgcggcatgctgatccgcgattactagcaattccggcttcatgcaggcgagttgcagcctgcaatccgaactacgaacggctttatgagattggctccacctcgcggtctcgcatctctttgtaccgcccattgtagcacgtgtgtagcccaagacataaggggcatgatgatttgacgtcatccccgccttcctccgg

SEQ ID NO: 470 - DNA, 220 bp, Unknown
  Description of Unknown: 16S RNA Operational Taxonomic Unit polynucleotide
  Phylum: Proteobacteria; Class: Gammaproteobacteria; Order: Xanthomonadales; Family: Xanthomonadaceae
aaaggcccgggaacgtattcaccgcagcaatgctgatctgcgattactagcgattccgacttcacggagtcgagttgcagactccgatccggactgagatggggtttctgggattggctcaccctcgcgggattgcagccctctgtccccacattgtagtacgtgtgtagccctggccgtaagggccatgatgacttgacgtcatccccaccttctccgg

SEQ ID NO: 471 - DNA, 220 bp, Unknown
  Description of Unknown: 16S RNA Operational Taxonomic Unit polynucleotide
  Phylum: Acidobacteria; Class: Chloracidobacteria
aagacccgggacgtattcaccgcagcatgctgatctgcgattactagcgattccaacttcatgaagtcgagttgcagacttcaatccgaactgagaccggcttttccgattggctccctttgcaggtttgcagcggtttgtaccggccattgtagcacgtgtgtagccctggacataaaggccatgaggacttgacgtcatccccacttcctccgttttg

SEQ ID NO: 472 - DNA, 220 bp, Unknown
  Description of Unknown: 16S RNA Operational Taxonomic Unit polynucleotide
  Phylum: Chloroflexi; Class: Bljii12; Order: B07_WMSP1; Family: FFCH4570
aaggcctgggaacgtattcactgccatgtgctgactggcagttactagcaactccgacttcatgcaggcgagttgcagcctgcaatccgaactgagaccggctttggtgggattagctccaggtcgccccttggcagcccgttgtaccggccattgtagcgtgtgtgtagccctcgacgtaagagccgtgctgacttgacgtcatccccaccttcctccg

SEQ ID NO: 473 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales; Family: Sphingobacteriaceae
aaggcccgggaacgtattcaccgcgtcattgctgatacgcgattactagcgaatccaacttcacggggtcgagttgcagaccccgatccgaactgtgaatggctttatggagatggcatcctgttgccaggtagctgccctctgtaccatccattgtagcacgtgtgtagccccggacgtaagggccatgatgacttgacgtcgtcccctccttcctctc

SEQ ID NO: 474 - DNA, 220 bp, Unknown
  Description of Unknown: 16S RNA Operational Taxonomic Unit polynucleotide
  Phylum: Proteobacteria; Class: Deltaproteobacteria; Order: Syntrophobacterales; Family: Syntrophobacteraceae
aaggcccgggaacgtattcaccgcggcatgctgatccgcgattactagcgattccagcttcacggagtcgagttgcagactccgatccgaactgagggcggttttgtgggattggctccgcctcgcggcctcgcctccctctgtaccgcccattgtagcacgtgtgtagccctgggtataaaggccatgatgacttgacgtcgtcccccttcctcccgcc

SEQ ID NO: 475 - DNA, 220 bp, Unknown
  Description of Unknown: 16S RNA Operational Taxonomic Unit polynucleotide
  Phylum: Proteobacteria; Class: Alphaproteobacteria; Order: Caulobacterales; Family: Caulobacteraceae
aaggccggaacgtattcaccgcggcatgctgatccgcgattactagcgattccaacttcatgctctcgagttgcagagaacaatccgaactgagacgacttttagggattggctccccctcgcgggattgcagaccctctgtagtcgccattgtagcacgtgtgtagcccaccttgtaagggccatgaggacttgacgtcatccccgccttcctccggat

SEQ ID NO: 476 - DNA, 220 bp, Unknown
  Description of Unknown: 16S RNA Operational Taxonomic Unit polynucleotide
  Phylum: Proteobacteria; Class: Betaproteobacteria
aagacccgggaacgtattcaccgcggcatgctgatccgcgattactagcgattccgacttcatgcagtcgagttgcagactgcaatccggactacgaccggctttcacgggatttggctccccctcgcgggttggcaaccctctgtaccggccattgtatgacgtgtgaagccctacccataagggccatgaggacttgacgtcatcccccaccttcctc

SEQ ID NO: 477 - DNA, 220 bp, Unknown
  Description of Unknown: 16S RNA Operational Taxonomic Unit polynucleotide
  Phylum: Proteobacteria; Class: Alphaproteobacteria; Order: Sphingomonadales
aaggcctggaacgtattcaccgcggcatgctgatccgcgattactagcgattccgccttcatgccctcgagttgcagaggacaatccgaactgagacgacttttggagattagctcacccttgcgggatagctgcccactgtcatcgccattgtagcacgtgtgtagcccagcttgtaagggccatgaggacttgacgtcatccccaccttctccggctt

SEQ ID NO: 478 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Cellulomonadaceae
aaggccccgggaacgtattcaccgcagcgttgctgatctgcgattactagcgactccgacttcatgaggtcgagttgcagacctcaatccgaactgagaccggctttttgggattcgctccaccttacggcatcgcagccctttgtaccggccattgtagcatgcgtgaagcccaagacataaggggcatgatgatttgacgtcatcccccaccttcctc

SEQ ID NO: 479 - DNA, 220 bp, Unknown
  Description of Unknown: 16S RNA Operational Taxonomic Unit polynucleotide
  Phylum: Cyanobacteria; Class: Nostocophycideae; Order: Nostocales; Family: Nostocaceae
acaaggcccggaacgaattcactgcagtatgctgacctgcaattactagcgattcctccttcacgcaggcgagttgcagcctgcgatctgaactgagcgccgatttccgggatttgcttgctatcgctagcttgctgccctctgttcggcgcattgtagtacgtgtgtagcccaagacgtaaggggcatgctgacttgacgtcatccccacttcctccgg

SEQ ID NO: 480 - DNA, 220 bp, Unknown
  Description of Unknown: 16S RNA Operational Taxonomic Unit polynucleotide
  Phylum: Proteobacteria; Class: Gammaproteobacteria; Order: Xanthomonadales; Family: Xanthomonadaceae
aagggcccgggaacgtattcaccgcagcaatgctgatctgcgattactagcgattccgacttcatggagtcgagttgcagactccaatccggactgagaaagggtttctgggattcggctcaccctcgcgggatcgcggccctctgtcccttccattgtagtacgtgtgtagccctggccgtaagggccatgatgacttgacgtcatccccaccttcctc

SEQ ID NO: 481 - DNA, 220 bp, Unknown
  Description of Unknown: 16S RNA Operational Taxonomic Unit polynucleotide
  Phylum: Proteobacteria; Class: Gammaproteobacteria; Order: Xanthomonadales; Family: Xanthomonadaceae
aaggccgggaacgtattcaccgcggcaatgctgatccgcgattactagcgattccgacttcacggagtcgagttgcagactccgatccggactaggatggggtttctgggattggctccggctcgcgccttggcgaccctctgtccccaccattgtagtacgtgtgtagccctggccgtaagggccatgatgacttgacgtcatcccaccttcctccgtt

SEQ ID NO: 482 - DNA, 220 bp, Unknown
  Description of Unknown: 16S RNA Operational Taxonomic Unit polynucleotide
  Phylum: TM7; Class: TM7-1
aagacccgggaacgtattcacggtagtatagctgacctaccgttactagcgattccgacttcaagcaggcgagtttcagcctgctatccgaactgggaccggctttgatgggatttgctccgtcttgcgacttggctgccctttgtaccggccattgtagcgtgtttgtagccccaggcgtaagggaaatactgactgacatcatcccctcttcctccct

SEQ ID NO: 483 - DNA, 220 bp, Unknown
  Description of Unknown: 16S RNA Operational Taxonomic Unit polynucleotide
  Phylum: Gemmatimonadetes; Class: Gemmatimonadetes; Order: Gemmatimonadales; Family: Gemmatimonadaceae
aaggcccgggaacgtattcaccgtggcgtagctgatccacgattactagcgattccagcttcatggaggcgagttgcagcctccaatccgcactgaggccggctttaagggattggcttgctatcgctagctcgcaacccgctgtaccggccattgtagcacgtgtgtagccctagacgtaaggaccatgatgacttgacgcgtcccaccttcctccggt

SEQ ID NO: 484 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatgaagtcgagttgcagacttcaatccgaactgagaagcgttttttgggattagctacacgtcaccgtgttgcagccctttgtacgctccattgtagcacgtgtgtagccctgggcataaaggccatgatgacttgacatcatcccctccttcctcac

SEQ ID NO: 485 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aagggtccgggaacgtattcaccgtagcgttgctgatctacgattactagcgattccagcttcatgcaggcgagttgcagcctgcaatccgaactgagagtgcgttttgggaattagctccttgttgccaagtggcagccctttgtcgcacccattgtagcacgtgtgtagccctgggcataaaggccatgatgacttgacatcatcccctcttcctcac

SEQ ID NO: 486 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Hyphomicrobiaceae
acaaggcccgggaacgtattcaccgcagcgtgctgatctgcgattactagcgattccaacttcatgtgctcgagttgcagagcacaatccgaactgagacggcttttggagatttgctagggattgctccttggcatccctctgtcaccgccattgtagcacgtgtgtagcccagcctgtaagggccatgaggacttgacgtcatccccaccttcctccg

SEQ ID NO: 487 - DNA, 220 bp, Unknown
  Description of Unknown: 16S RNA Operational Taxonomic Unit polynucleotide
  Phylum: Proteobacteria; Class: Gammaproteobacteria; Order: Chromatiales; Family: Sinobacteraceae
aagacccgggaacgtattcaccgcgacaatgctgattcgcgattactagcgattccgacttcacggagtcgagttgcagactccgatccggacacgaccggctttctgggattggctcccgcttgcgcgttggcaaccctttgtaccggccattgtagcacgtgtgtagccctggccataaaggccatgatgacttgacgtcatccccacttctccggtt

SEQ ID NO: 488 - DNA, 220 bp, Unknown
  Description of Unknown: 16S RNA Operational Taxonomic Unit polynucleotide
  Phylum: Proteobacteria; Class: Deltaproteobacteria; Order: Myxococcales
aaggcccggaacgtatcgaccgctgcctgctgatcagcgattactagcgattccgacttcatgtactcgagttgcagagtacaatctgtactgaggtgcactttttgcgattggcttactctcgcgagcttgctgcgctctgtatgcaccattgtagcacgtgtgtagccctggacataagggccatgaggacttgacgtcgtccccaccttcctccggc

SEQ ID NO: 489 - DNA, 220 bp, Unknown
  Description of Unknown: 16S RNA Operational Taxonomic Unit polynucleotide
  Phylum: Verrucomicrobia; Class: Spartobacteria; Order: Spartobacteriales; Family: Spartobacteriaceae
aaggcccgggaacgtattcacgccgtcgtagctgatacggcattactagcgattccggcttcatggagtcgagttgcagactccaatccgaactgggcccagtttactggatttcctccaccttgcggtctcggatcgttctgtactgggcattgtagtacgtgtgcagccctggccgtaagggccatactgacttgacgtcgtccccacttcctcccct

SEQ ID NO: 490 - DNA, 220 bp, Unknown
  Description of Unknown: 16S RNA Operational Taxonomic Unit polynucleotide
  Phylum: Acidobacteria; Class: Acidobacteria; Order: Acidobacteriales
aaggccggacgtattcaccgcggcgtgctgatccgcgattactagcgattccaacttcaagcaggcgagttgcagcctgctatccgaactgagaccggctttctccgattagctccaccttacggtatcgcgacggtttgtaccggccattgtagcacgtgtgtagccccagacataaaggccatgctgacttgacgtcatccccaccttcctccggttt

SEQ ID NO: 491 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Bradyrhizobiaceae
aaggcccgggaacgtattcaccgtggcatgctgatccacgattactagcgattccaacttcatgggctcgagttgcagagcccaatccgaactgagacggcttttgagatttgcgaagggtcgccccttagcatcccattgtcaccgccattgtagcacgtgtgtagcccagcccgtaagggccatgaggacttgacgtcatccccacctctcgcggcta

SEQ ID NO: 492 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatggagtcgagttgcagactccaatctgaactgagagtacgttttttgggattagctccttatcactaagtggcagccctttgtacgccccattgtagcacgtgtgtagccctgggcataaaggccatgatgacttgacatcatccccctcttcctcg

SEQ ID NO: 493 - DNA, 220 bp, Unknown
  Description of Unknown: 16S RNA Operational Taxonomic Unit polynucleotide
  Phylum: Cyanobacteria; Class: Synechococcophycideae; Order: Synechococcales; Family: Acaryochloridaceae
aaggcccgggaacgtattcaccgcagtatgctgacctgcgattactagcgattccgccttcatgcaggcgagttgcagcctgcaatctgaactgagccgtggttatgggattagctcactctcgcgagttggcaaccctttgtccacagcattgtagtacgtgtgtagcccaggacgtaagggcatgctgacttgacgtcatccccaccttcctccccgc

SEQ ID NO: 494 - DNA, 220 bp, Unknown
  Description of Unknown: 16S RNA Operational Taxonomic Unit polynucleotide
  Phylum: Verrucomicrobia; Class: Verrucomicrobiae; Order: Verrucomicrobiales; Family: Verrucomicrobia subdivision 3
aaggcctgggaacgtattcacggcgccgtagctgatgcgccattactagcgattccagcttcatgccgtcgagttgcagacgacaatctgaactgggcccggttttggggatttgctccaccttacggtctcgcttccctttgtgccgggcattgtagtacgtgtgcagccctggccgtaagggccatactgacttgacgtcatcccacttcctcctccg

SEQ ID NO: 495 - DNA, 220 bp, Unknown
  Description of Unknown: 16S RNA Operational Taxonomic Unit polynucleotide
  Phylum: Verrucomicrobia; Class: Verrucomicrobiae; Order: Verrucomicrobiales; Family: Verrucomicrobia subdivision 3
aaggcctgggaacgtattcacggcgccgtagctgatgcgccattactagcgattccagcttcatgaaggcgagttgcagccttcaatctgaactgggcccggtttttggggatttgctccacctcgcggtcttgcttccctttgtgccgggcattgtagtacgtgtgcagccctggccgtaagggccatactgacttgacgtcatccccacttcctccca

SEQ ID NO: 496 - DNA, 220 bp, Unknown
  Description of Unknown: 16S RNA Operational Taxonomic Unit polynucleotide
  Phylum: Chloroflexi
aagacccgggaacgtattcaccgccgtgtgctgaccggttactagcaactccgacttcatgcaggcgagttgcagcctgcaatccgaactgagaccgcgtttgctgcgattcgctccaggtcgccccttcgcggcgcattgtcgcggccattgtagcgtgtgtgtagccctggacgtaagggccgtgctgacttgacgtcatccccgccttcctccgggt

SEQ ID NO: 497 - DNA, 220 bp, Unknown
  Description of Unknown: 16S RNA Operational Taxonomic Unit polynucleotide
  Phylum: Proteobacteria; Class: Gammaproteobacteria; Order: Xanthomonadales; Family: Xanthomonadaceae
gaggcccgggaacgtattcaccgcgacaatgctgattcgcgattactagcgattccgacttcacggagtcgagttgcagactccgatccggactgagatcggctttctgggattggctccgcctcgcggcattgcgaccctctgtaccgaccattgtagtacgtgtgtagccctggccgtaagggccatgatgacttgacgtcatccccacttcctccgg

SEQ ID NO: 498 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Kineosporiaceae
aaggcccggaagtattcgaccgcgagcgttgctgatctgcgattactagcgactccgacttcacggggtcgagttgcagaccccgatccgaactgagaccagctttttgggattcgctccacctcacggtctcgcagccctttgtactggccattgtagcatgcgtgaagcccaagacataaggggcatgatgatttgacgtcgtcccaccttcctccga

SEQ ID NO: 499 - DNA, 220 bp, Unknown
  Description of Unknown: 16S RNA Operational Taxonomic Unit polynucleotide
  Phylum: Actinobacteria; Class: Actinobacteria; Order: MC47
agggcccgggaacgtattcaccgcggcgttgctgatccgcgattactagcaactccgccttcatggaggcgagttgcagcctccaatccgaaccgggaccggctttttgggattcgctcaacctcgcggttttgcagccctttgtaccggccaatgtagcacgtgtgtagcccaagacataaggggcatgatgacttgacctcatcccccttcctccgac

SEQ ID NO: 500 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Rhizobiaceae
aaggcccgggacgtattcaccgtggcattctgatccacgattactagcgattccaacttcatgcactcgagttgcagagtgcaatccgaactgagatggctttggagattagctcgacctcgcggtctcgctgcccactgtcaccaccattgtagcacgtgtgtagcccagcccgtaagggccatgaggacttgacgtcatccccaccttcctctcggct

SEQ ID NO: 501 - DNA, 220 bp, Unknown
  Description of Unknown: 16S RNA Operational Taxonomic Unit polynucleotide
  Phylum: Proteobacteria; Class: Gammaproteobacteria; Order: Xanthomonadales; Family: Xanthomonadaceae
aaggcccgggaacgtattcaccgcggcaatgctgatccgcgattactagcgattccgacttcacgcagtcgagttgcagactgcgatccggactgagatagggtttctgggattggctccgcctcgcggcatcgcgaccctctgtccccaccattgtagtacgtgtgtagccctggtcgtaagggccatgatgacttgacgtcatccccacttcctccgg

SEQ ID NO: 502 - DNA, 220 bp, Unknown
  Description of Unknown: 16S RNA Operational Taxonomic Unit polynucleotide
  Phylum: Proteobacteria; Class: Alphaproteobacteria; Order: Caulobacterales; Family: Caulobacteraceae
aaggcccggaacgtattcaccgcgggcatgctgatccgcgattactagcgattccaacttcatgcactcgagttgcagagtgcaatccgaactgagacgacttttagggattggcctccccctcgcgggattgcagccctctgtagtcgccattgtagcacgtgtgtagcccaccttgtaagggccatgaggacttgacgtcatccccacttcctccggc

SEQ ID NO: 503 - DNA, 220 bp, Unknown
  Description of Unknown: 16S RNA Operational Taxonomic Unit polynucleotide
  Phylum: Acidobacteria; Family: Koribacteraceae
aaggcccgggaacgtattcaccgcggcgttctgatccgcgattactagcgattccagcttcatggagtcgggttgcagactccaatccgaactgaggccggctttttccgatttagctcccttcgcaggtttgcgacggtttgtaccgaccattgtagcacgtgtgtagccctggacataaaggccatgaggacttgacgtcatccccacttcctccccg

SEQ ID NO: 504 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Hyphomicrobiaceae
aggcccggacgtattcaccgcagcgtgctgatctgcgattactagcgattccaacttcatgtgctcgagttgcagagcacaatccgaactgagacggctttttgagatttgcgaaggattactcctttgcgtccctctgtcaccgccattgtagcacgtgtgtagcccagcctgtaagggccatgaggacttgacgtcatccccacttcctccggcttat

SEQ ID NO: 505 - DNA, 220 bp, Unknown
  Description of Unknown: 16S RNA Operational Taxonomic Unit polynucleotide
  Phylum: Acidobacteria; Class: Chloracidobacteria
aagacccgggacgtattcaccgcagcgttctgatctgcgattactagcgattccaacttcatgaagtcgagttgcagacttcaatccgaactgagaccggttttgcgattagctccctcttgcgagattgcgacgttttgtaccggccattgtagcacgtgtgtagccctgaacataaaggccatgatgacttgacatcatccccactcctccgtttatc

SEQ ID NO: 506 - DNA, 220 bp, Unknown
  Description of Unknown: 16S RNA Operational Taxonomic Unit polynucleotide
  Phylum: Acidobacteria; Family: Koribacteraceae
aaggcccgggaacgtattcaccgcagcgtgctgatctgcgattactagcgattccagcttcatggagtcgagttgcagactccaatccgaactggggacgctttttccgattagctccccctcacgggtttgcgacggttgtaccgaccattgtagcacgtgtgtagccctggacataaaggccatgaggacttgacgtcatcccaccttcctccccgtt

SEQ ID NO: 507 - DNA, 220 bp, Unknown
  Description of Unknown: 16S RNA Operational Taxonomic Unit polynucleotide
  Phylum: Proteobacteria; Class: Gammaproteobacteria; Order: Xanthomonadales; Family: Xanthomonadaceae
aaggcccggaacgtattcaccgcggcattgctgatccgcgattactagcgattccgacttcacgcagtcgagttgcagactgcgatccggactgggatagggtttctgggattggctccacctcgcggcttcgcgaccctctgtccccaccattgtagtacgtgtgtagccctggccgtaagggccatgatgacttgacgtcatccccaccttcctccgg

SEQ ID NO: 508 - DNA, 220 bp, Unknown
  Description of Unknown: 16S RNA Operational Taxonomic Unit polynucleotide
  Phylum: Chloroflexi; Class: Bljii12; Order: B07_WMSP1; Family: FFCH4570
gaggcccgggaacgtattcacggctgtgtgctgaccagccgttactagcaactccgacttcacgcaggcgagttgcagcctgcgatccgaactgagaccggctttggtgggattagctccgcctcgcggcttggcagcccgttgtaccggccattgtagcgtgtgtgtagccctcgacgtaagagccgtgctgacttgacgtcatccccaccttcctccg

SEQ ID NO: 509 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Glycomycetaceae
aaggcccgggaacgcattcaccgcagcgttgctgatctgcgattactagcgactccaccttcatcgagtcgagttgcagactcgaatccgaaccaagaccggctttacagggattcgctccaccctcacggtatcgcaacccgctgtaccggccaatgtagcatgcgtgaacgccctagacagtaagggcatgatgacttgacctcactccccaccttcc

SEQ ID NO: 510 - DNA, 220 bp, Unknown
  Description of Unknown: 16S RNA Operational Taxonomic Unit polynucleotide
  Phylum: Gemmatimonadetes; Class: Gemmatimonadetes; Order: Gemmatimonadales; Family: Gemmatimonadaceae
agggcccgggaacgtattcaccgtggcgtagctgatccacgattactagcgattccagcttcatggaggcgagttgcagcctccaatccgaactgaggccgggtttggggattggctcatgcttgcgcatttgcaacccgctgtcccggccattgtagcacgtgtgtagccctagacgtaaggaccatgatgacttgacgtcgtccccaccttcctccgg

SEQ ID NO: 511 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Hyphomicrobiaceae
aaggcccgggaacgtattcaccgcagcgtgctgatctgcgattactagcgattccaacttcatgcactcgagttgcagagtgcaatccgaactgagacggctttttgagatttgcgcagggttgccccattgcgtcccattgtcacgccattgtagcacgtgtgtagcccaactgtaagggccatgaggacttgacgtcatccccacttcctcgcggctt

SEQ ID NO: 512 - DNA, 220 bp, Unknown
  Description of Unknown: 16S RNA Operational Taxonomic Unit polynucleotide
  Phylum: Actinobacteria; Class: Actinobacteria; Order: Acidimicrobiales; Family: EB1017
aagacccgggaacgtattcaccgcagcaatgctgatctgcgattactagcgactccgacttcacgcagtcgagttgcagactgcgatccgaactgagaccggctttctgggattggcgtcttctcgcgaagtagcaaccctttgtaccggccattgtagcatgtgtgcagccctggacgtaaggggcatgatgacttgacgtcgtcccccttcctccgtt

SEQ ID NO: 513 - DNA, 220 bp, Unknown
  Description of Unknown: 16S RNA Operational Taxonomic Unit polynucleotide
  Phylum: Cyanobacteria; Class: Nostocophycideae; Order: Nostocales; Family: Nostocaceae
aagacccgggaacgtattcactgcagtatgctgacctgcaattactagcgattcctccttcacgcaggcgagttgcagcctgcgatctgaactgagccacggtttatgagatttgcttgctatcgctagcttgctgccctttgtccgtagcattgtagtacgtgtgtagcccaagacgtaaggggcatgctgacttgacgtcatccccacttcctccggt

SEQ ID NO: 514 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales; Family: Flexibacteraceae
aaggcccgggaacgtattcaccgcgtcattgctgatacgcgattactagcgattccagcttcacgaagtcgagttgcagacttcgatccgaactgagagcggcttttgtagattggcatcctgtcaccaggtagcaaccctcctgtaccgcccacttgtagcacgtgtgtagccctacggcgtaagggccatgatgacctgacgtcatccccaccctccc

SEQ ID NO: 515 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aagatccgggaacgtattcaccgtatcattgctgatatacgattactagcgattccagcttcacgcagtcgagttgcagactgcgatctgaactgagagaaggtttttgagattagctccctgtcaccaggtggcagccctttgtccttcccattgtagcacgtgtgtagccctgggcataaaggccatgatgacttgacatcatcccctcttcctcgcg

SEQ ID NO: 516 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatgagggcgagttgcagccctcaattcgaactgagataggatttttgagattagcatcctgttaccaggtagcagccctttgttcctaccattgtagcacgtgtgtagccctgggcataaagaccgacaggatgacttgacatcatcccctcttcctc

SEQ ID NO: 517 - DNA, 220 bp, Unknown
  Description of Unknown: 16S RNA Operational Taxonomic Unit polynucleotide
  Phylum: Actinobacteria; Class: Actinobacteria; Order: MC47
aaggcccgagaacgtaggtcaccggcggcgttgctgatccgcgattactagcaactccgccttcatggaggcgagtttcagcctccaatccgaaccgggaccggctttttgggattcgctccccctcacgggtttgcagccctctgtaccggccaatgtagcacgtgtgtagcccgagacgtaaggggcatgatgacttgacgtcatccccacttcctcc

SEQ ID NO: 518 - DNA, 220 bp, Unknown
  Description of Unknown: 16S RNA Operational Taxonomic Unit polynucleotide
  Phylum: Verrucomicrobia; Class: Spartobacteria; Order: Spartobacteriales; Family: Spartobacteriaceae
aaggcccaggaacgtattcacggcgccgtagctgatgcgccattactagcgattccggcttcatggagtcgagttgcagactccaatctgaactgggcccagttttagagatttcctccaccttgcggtctcggatcgttctgtgctgggcattgtagtacgtgtgcagcccaggccgtaagggccatactgacttgacgtcgtccccaccttcctcccg

SEQ ID NO: 519 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcacgcagtcgagttgcagactgcgatctgaactgagaggcgttttttgggattggctccttatcgctaagtggcagccctttgtacgccccacttgtagcacgtgtgtagccctgggcataaaggccatgatgacttgacatcactcccctccttccct

SEQ ID NO: 520 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Micromonosporaceae
aaggcccgggaacgtattcaccgcagcaatgctgatctgcgattactagcgactccgacttcacggggtcgagttgcagaccccgatccgaactgagaccggctttttccgattcgctccccctcacgggctcgcaacggtttgtaccggccattgtagcatgcgtgaagccctggacataaggggcatgatgacttgacgtcatccccacttctccagt

SEQ ID NO: 521 - DNA, 220 bp, Unknown
  Description of Unknown: 16S RNA Operational Taxonomic Unit polynucleotide
  Phylum: Chloroflexi
aaggcccgggaacgtattcaccgcaccgtgctgatgtcgcggttactagcaactccgacttcaagcaggcgagttgcagcctgctatccgaactgagaccggctttgtgggattagctccacctcgcggcttcgcagcccctctgtaccggccattgtagcgtgtgtgtagcccagggacgtaagagccatgctgacttgacgtcatccccaccttcctc

SEQ ID NO: 522 - DNA, 220 bp, Unknown
  Description of Unknown: 16S RNA Operational Taxonomic Unit polynucleotide
  Phylum: Proteobacteria; Class: Alphaproteobacteria; Order: Sphingomonadales; Family: Sphingomonadaceae
acaaggcctgggaacgtattcaccgcggcatgctgatccgcgattactagcgattccgccttcatgctctcgagttgcagagaacaatccgaactgagacggctttggagattagctcaccctcgcgggtttgcagccctctgtcaccgccattgtagcacgtgtgtagccccagcgcgtaagggccatgaggacttgacgtcatccccacttcctccgg

SEQ ID NO: 523 - DNA, 220 bp, Unknown
  Description of Unknown: 16S RNA Operational Taxonomic Unit polynucleotide
  Phylum: Proteobacteria; Class: Alphaproteobacteria; Order: Rhodospirillales; Family: Rhodospirillaceae
aaaggcccgggaacgtattcaccgaggcatgctgatcctcgattactagcgattccaacttcatgcactcgagttgcagagtgcaatccgaactgagtacggctttttaggatcggctccggctcgcgccatcgcatcccattgtcaccgccattgtagcacgtgtgtagcccagcccgtaagggccatgaggacttgacgtcatccccacttcctccgg

SEQ ID NO: 524 - DNA, 220 bp, Unknown
  Description of Unknown: 16S RNA Operational Taxonomic Unit polynucleotide
  Phylum: Proteobacteria; Class: Betaproteobacteria; Order: Burkholderiales
aagacccgggaacgtattcaccgcggcaagctgatccgcgattactagcgattccgacttcacgcagtcgagttgcagactgcgatccggactacgaccggttttctggggattgggctccccctcgcgggttggcagccctctgtaccggcccattgtatgacgtgtgtagccctacccataagggccatgaggacctgacgtcatcccaccttcctct

SEQ ID NO: 525 - DNA, 220 bp, Unknown
  Description of Unknown: 16S RNA Operational Taxonomic Unit polynucleotide
  Phylum: Acidobacteria; Class: iii1-8; Order: DS-18
aaggcccgggaacgtattcaccgcggcgtgctgatccgcgattactagcgattccagcttcatgcagtcgagttgcagactgcaatccgaactgagaacggttttttgagatagctcaacctcgcggtttgtcgactctttgtgccgtccattgtagcacgtgtgtagccctggacataaaggccatgaggacttgacgtcatccccaccttcctccggt

SEQ ID NO: 526 - DNA, 220 bp, Unknown
  Description of Unknown: 16S RNA Operational Taxonomic Unit polynucleotide
  Phylum: Proteobacteria; Class: Betaproteobacteria
aagacccgggacgtattcaccgcgacatgctgatccgcgattactagcgattccgacttcatgcagtcgagttgcagactgcaatccggactacgacgcgctttaagggattggctccagatcgctccttggcaacctctgtacgcgccattgtattacgtgtgaagccctaccataagggccatgaggacttgacgtcatccccacttctccggtttgt

SEQ ID NO: 527 - DNA, 220 bp, Unknown
  Description of Unknown: 16S RNA Operational Taxonomic Unit polynucleotide
  Phylum: Proteobacteria; Class: Betaproteobacteria
aagacccggacgtattcaccgcgacatgctgatccgcgattactagcgattccgacttcaaggagtcgagttgcagactcctatccggactacgacgcgctttaagggattggctccacctcgcggcttggcaacctctgtacgcgccattgtattacgtgtgaagccctacccataagggccatgaggacttgacgtcatccccacttcctccggtttg

SEQ ID NO: 528 - DNA, 220 bp, Unknown
  Description of Unknown: 16S RNA Operational Taxonomic Unit polynucleotide
  Phylum: Gemmatimonadetes; Class: Gemmatimonadetes; Order: Gemmatimonadales; Family: Gemmatimonadaceae
aaggcccgggaacgtattcaccgtggcgtagctgatccacgattactagcgattccagcttcatgccctcgggttgcagaggacaatccgaactgagggcgggtttacgggattggctccgccttgcgactttgcgaccctttgtcccgcccattgtagcacgtgtgtagcccctggacgtaaggaccatgatgacttgacgtcgtcccacttcctccgt

SEQ ID NO: 529 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Microbacteriaceae
aagacccgggaacgtattcaccgcagcgttgctgatctgcgattactagcgactccgacttcatgaggtcgagttgcagacctcaatccgaactgggaccggctttttgggattcgctccccttacggtatcgcagccctttgtaccggccattgtagcatgcgtgaagccctggacataaggggcatgatgacttgacgtcatcccaccttcctccgag

SEQ ID NO: 530 - DNA, 220 bp, Unknown
  Description of Unknown: 16S RNA Operational Taxonomic Unit polynucleotide
  Phylum: Proteobacteria; Class: Betaproteobacteria; Order: Burkholderiales
aagacccgggaacgtattcaccgcggcaagctgatccgcgattactagcgattccgacttcacgcagtcgagttgcagactgcgatccggactacgaccggtttttctgggatggctccccctcgcgggttggcagccctctgtaccggccattgtatgacgtgtgtagccctacccataagggccatgaggacctgacgtcatccccaccttcctccgg

SEQ ID NO: 531 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Rhizobiaceae
aaggcccggacgtatcgaccgcgagcatgctgatctgcgattactagcgattccaacttcatgcactcgagttgcagagtgcaatccgaactgagatggcttttggagattagctcgacatcgctgtctcgctgcccactgtcaccaccattgtagcacgtgtgtagcccagcccgtaagggccatgaggacttgacgtcatccccacttcctctcggct

SEQ ID NO: 532 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Hyphomicrobiaceae
aaggcccggaacgtattcaccgcagcgtgctgatctgcgattactagcgattccaacttcatggggtcgagttgcagaccccaatccgaactgagacggctttttgagatttgcgaagggtcgccctttgcatccctctgtcaccgccattgtagcacgtgtgtagcccagcccgtaagggccatgaggacttgacgtcatccccacttcctccggctta

SEQ ID NO: 533 - DNA, 220 bp, Unknown
  Description of Unknown: 16S RNA Operational Taxonomic Unit polynucleotide
  Phylum: Acidobacteria; Class: Chloracidobacteria
aagacccgggaacgtattcaccgcggcgttctgatccgcgattactagcgattccaacttcatggagtcgagttgcagactccaatccgaactgagaccggtttttgcgattagcttccccttgcgggatcgcgacgttttgtaccggccattgtagcacgtgtgtagccctaagcataaaggccatgatgacttgacatcatccccaccttcctccgtc

SEQ ID NO: 534 - DNA, 220 bp, Unknown
  Description of Unknown: 16S RNA Operational Taxonomic Unit polynucleotide
  Phylum: Chloroflexi; Class: Ktedonobacteria
aagacccgggaacgtattcaccgtagtgtgctgacctacggttactagcaactccgacttcatgcaggcgggttgcagcctgcaatctgaactgagatcaagtttgctgagattggctccccctcgcgggttggcaactcattgtcctgaccattgtagcgtgtgtgtcgcccaggatgtaagggccgtgctgacttgacgtcatccccaccttcctccg

SEQ ID NO: 535 - DNA, 220 bp, Unknown
  Description of Unknown: 16S RNA Operational Taxonomic Unit polynucleotide
  Phylum: Actinobacteria; Class: Actinobacteria; Order: MC47
aaggcccgggaacgtattcaccgcggcattgctgatccgcgattactagcaactccgccttcatggaggcgagtttcagcctccaatccgaaccgggaccggcttttttgggatttcgctccccctcgcgggtttgcagcccttttgtaccggccaatgtagcacgtgtgtagccctaggcataaggggcatgatgacttgacatcatccccaccttcct

SEQ ID NO: 536 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatgaagtcgagttgcagacttcaatctgaactgagagatgttttttgagattggcttcacgtcaccgtgttgctgctctttgtacaccccattgtagcacgtgtgtagccctgggcataaaggccatgatgacttgacgtcatccccactcctccggt

SEQ ID NO: 537 - DNA, 220 bp, Unknown
  Description of Unknown: 16S RNA Operational Taxonomic Unit polynucleotide
  Phylum: Verrucomicrobia; Class: Verrucomicrobiae; Order: Verrucomicrobiales
aaggcctgggaacgtattcacggcgccgtagcgttgatgcgccattactagcgattccagcttcatgtcgtcgagttgcagacgacaatctgaactgggcccggttttctgggatttgctcacctgacggtcttgctccctttgtgccgggcattgtagtacgtgtgcagccctggccgtaagggccatactgacttgacgtcatccccaccttcctcct

SEQ ID NO: 538 - DNA, 220 bp, Unknown
  Description of Unknown: 16S RNA Operational Taxonomic Unit polynucleotide
  Phylum: Acidobacteria; Class: iii1-8; Order: DS-18
aaggcccgggaacgtattcaccgcggcgtgctgatccgcgattactagcgattccagcttcatgcagtcgagttgcagactgcaatccgaactgagaatggtttttgagattagctccacctcgcggcatcgcaactctttgtaccatccattgtagcacgtgtgtagccctggacataaaggccatgaggacttgacgtcatccccactcctccggtat

SEQ ID NO: 539 - DNA, 220 bp, Unknown
  Description of Unknown: 16S RNA Operational Taxonomic Unit polynucleotide
  Phylum: Acidobacteria; Class: iii1-8; Order: 32-20
aaggcccgggacgtattcaccgcggcgtgctgatccgcgattactagcgattccagcttcatggggtcgagttgcagaccccaccgaactgagaccggctttatccgattgctccaacttgcgttctcgcaacggtttgtaccggccattgtagcacgtgtgtagccctggacataaaggccatgaggacttgacgtcatccccaccttcctccggttta

SEQ ID NO: 540 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Oxalobacteraceae
aagacccgggaacgtattcaccgcgacatgctgatccgcgattactagcgattccaacttcacgtagtcgagttgcagactacgatccggactacgatacactttctggattagctccccctcgcgggttggcggccctctgtatgtaccattgtatgacgtgtgaagccctacccataagggccatgaggacttgacgtcactccccacccttcctccc

SEQ ID NO: 541 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtagcgttgctgatctacgattactagcgattccagcttcatggagtcgagttgcagactccaatctgaactgagaagaggtttttgggattagcttcgagtaattactatgttgcagccctttgtcctctccattgtagcacgtgtgtagccctgggcataaaggccatgatgacttgacatcatcccctccttcct

SEQ ID NO: 542 - DNA, 220 bp, Unknown
  Description of Unknown: 16S RNA Operational Taxonomic Unit polynucleotide
  Phylum: Acidobacteria; Class: Acidobacteria-5
aagacccgggaacgtattcaccgctgcttgctgatcagcgattactagcgattccagcttcatgcagtcgagttgcagactgcaatccgaactgagaatggttttttgagattggctccctctcgcgagtttgcgactcattgtgccatccattgtagtacgtgtgtagccctggacataaaggccatgaggacttgacgtcatcccccttcctccggtt

SEQ ID NO: 543 - DNA, 220 bp, Unknown
  Description of Unknown: 16S RNA Operational Taxonomic Unit polynucleotide
  Phylum: Verrucomicrobia; Class: Opitutae; Order: Opitutales; Family: Opitutaceae
gaggcccgggaacgtattcacggcgccgtagctgatgcgccattactagcgattccaacttcatgtagtcgagttgcagactacaatctgaactgggctcggttttgaggatttgctccacctcgcggtattgcgtccctctgtgccgagcattgtagtacgtgtgcagccctagccgtaagggccatcctgacttgacgtcatccccacttcccacccc

SEQ ID NO: 544 - DNA, 220 bp, Unknown
  Description of Unknown: 16S RNA Operational Taxonomic Unit polynucleotide
  Phylum: Acidobacteria; Class: Chloracidobacteria
aagaccgggaacgtattcaccgcaacatgctgatttgcgaattactagcgattccaacttcatgaagtcgagttgcagacttcaatccgaactgagaacggttttagcgattagctccctcttacgagattgcgacgttttgtaccgtccattgtagcacgtgtgtagccctgaacataaaggccatgatgacttgacatcatccccaccttcctccgtt

SEQ ID NO: 545 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales; Family: Sphingobacteriaceae
aaggcccgggaacgtattcaccgcagcattgctgatctgcgattactagcgaatccaacttcacggggtcgagttgcagaccccgatccgaactgtgaccggctttttgagattggcttcctgttgccaggtcgctgccctctgtaccggccattgtagcacgtgtgtagccccggacgtaagggccatgatgacttgacgtcgtcccctccttcctccg

SEQ ID NO: 546 - DNA, 220 bp, Unknown
  Description of Unknown: 16S RNA Operational Taxonomic Unit polynucleotide
  Phylum: Cyanobacteria; Class: Nostocophycideae; Order: Nostocales; Family: Nostocaceae
aagcccgggacgaattcactgcagtatgctgacctgcaattactagcgattcctccttcacgcaggcgagttgcagcctgcgatctgaactgagctccggtttacgggatttgcttgcattcgcatgcttgctgccctctgtccggagcattgtagtacgtgtgtagcccaaggcgtaaggggcatgctgacttgacgtcatccccaccttcctccggtt

SEQ ID NO: 547 - DNA, 220 bp, Unknown
  Description of Unknown: 16S RNA Operational Taxonomic Unit polynucleotide
  Phylum: Proteobacteria; Class: Alphaproteobacteria; Order: Rhodospirillales; Family: Rhodospirillaceae
aaggcccgggaacgtattcaccgcggcgtgctgatccgcgattactagcgattccaacttcatgcacccgagttgcagagtgcaatccgaactgagatggcttttggagatcggctccgggtcgccccttcgctcccactgtcaccaccattgtagcacgtgtgtagcccagcccactaagggccatgaggacttgacgtcatccccgccttcctccggc

SEQ ID NO: 548 - DNA, 220 bp, Unknown
  Description of Unknown: 16S RNA Operational Taxonomic Unit polynucleotide
  Phylum: Proteobacteria; Class: Alphaproteobacteria; Order: Rhodospirillales; Family: Rhodospirillaceae
aaggcccgggaacgtattcaccgcggcgtgctgatccgcgattactagcgattccgacttcatgctctcgagttgcagagagcaatccgaactgagacggttttttgagattggctcaggctcgcaccctcgctcccctctgtcaccgccattgtagcacgtgtgtagcccagcccataagggccatgaggacttgacgtcatccccgccttctccggct

SEQ ID NO: 549 - DNA, 220 bp, Unknown
  Description of Unknown: 16S RNA Operational Taxonomic Unit polynucleotide
  Phylum: Gemmatimonadetes; Class: Gemmatimonadetes; Order: Gemmatimonadales; Family: Gemmatimonadaceae
agggcccgggaacgtattcaccgtggcgtagctgatccacgattactagcgattccagcttcatggaggcgagttgcagcctccaatccgcactgagatcggctttacgggattggcttgccatcgctagctcgcaaccctttgtaccgatcattgtagcacgtgtgtagccctagacgtaaggaccatgatgacttgacgtcgtccccaccttcctccg

SEQ ID NO: 550 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtagcgttgctgagtctacggaattactagcgattccagcttcatggagtcgagttgcagactccaatctgaactgagaggcgttttttgggattagcttcatattgctatgttgcagccctttgtacgccccattgtagcacgtgtgtagccctgggcataaaggccatgatgacttgacatcatcccctcttcctc

SEQ ID NO: 551 - DNA, 220 bp, Unknown
  Description of Unknown: 16S RNA Operational Taxonomic Unit polynucleotide
  Phylum: Verrucomicrobia; Class: Spartobacteria; Order: Spartobacteriales; Family: Spartobacteriaceae
aaggcccgggaacgtattcacgccgtcgtagctgatacggcattactagcgattccggcttcatggaggcgagttgcagcctccaatccgaactgagcccagttttactagatttcctccctcgcggtctcggatcgttctgtactgggcattgtagtacgtgtgcagccctggccgtaagggccatactgacttgacgtcgtccccacttcctccccgt

SEQ ID NO: 552 - DNA, 220 bp, Unknown
  Description of Unknown: 16S RNA Operational Taxonomic Unit polynucleotide
  Phylum: Acidobacteria; Class: iii1-8; Order: 32-20
aaggcctgggaacgtattcaccgcggcgtgctgatccgcgattactagcgattccagcttcatggggtcgagttgcagaccccaatccgaactgagaccggctttatccgatttgctccagcttgcgctctcgcaacggtttgtaccggccattgtagcacgtgtgtagccctggacataaaggccatgaggacttgacgtcatccccaccttcctccgg

SEQ ID NO: 553 - DNA, 220 bp, Unknown
  Description of Unknown: 16S RNA Operational Taxonomic Unit polynucleotide
  Phylum: Chloroflexi
aaggcccgggaacgaattcaccgcgctatgctgacacgcggttactagcaactccgacttcatgcactcgggttgcagagtgcaatctgaactgaggcaccctttggaggtctgctctccctcgcgggatggcttctcactgtaagtgccattgtagcgtgtgtgtagcccaggacgtaagagccatgctgacttgacgtcatccccaccttcctcccct

SEQ ID NO: 554 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aagacccgggaacgtattcaccgtagcgttgctgatctacgattactagcgattccagcttcatgcaggcgagttgcagcctgcaatctgaactgagagaggttttttgagattagcatcctgtcaccaggtagcagccctttgtccccccattgtagcacgtgtgtagccctgggcataaaggccatgatgacttgacatcatcccctccttcctcacg

SEQ ID NO: 555 - DNA, 220 bp, Unknown
  Description of Unknown: 16S RNA Operational Taxonomic Unit polynucleotide
  Phylum: Gemmatimonadetes; Class: Gemmatimonadetes; Order: Gemmatimonadales; Family: Gemmatimonadaceae
aagacccgggaacgtattcaccgcggcgtagctgatccgcgattactagcgattccagcttcatggaggcgggttgcagcctccaatccgcactgaggccggctttcgggattggctccaggttgccctgtcgcagcccgctgtaccggccattgtagcacgtgtgtagccctggacgtaaggaccatgatgacttgacgtcgtccccaccttcctccgg

SEQ ID NO: 556 - DNA, 220 bp, Unknown
  Description of Unknown: 16S RNA Operational Taxonomic Unit polynucleotide
  Phylum: Proteobacteria; Class: Alphaproteobacteria; Order: Sphingomonadales
gaggcctgggaacgtattcaccgcggcatgctgatccgcgattactagcgattccgccttcatgctctcgagttgcagagaacaatccgaactgagacggcttttggagattagctcactctcgcgagtttgctgcccactgtcaccgccattgtagcacgtgtgtagcccagcctgtaagggccatgaggacttgacgtcatccccaccttcctccggc

SEQ ID NO: 557 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aaggccggaacgtattcccgcagcaagtgctgatctgcgattactagcaactccgacttcatggggtcgagttgcagaccccaatccgaactgagacaggctttttgagattcgctccacctcacggtatcgcagctcattgtacctgccattgtagcacgtgtgcagcccaagacataaggggcatgatgacttgacgtcgtccccaccttcctccgag

SEQ ID NO: 558 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatggagtcgagttgcagactccaatctgaactgagaggaggtttttgggattagctcctatcactaagtggcagccctttgtcctccccattgtagcacgtgtgtagccctgggcataaaggccatgatgacttgacatcatcccctcttcctcgcgt

SEQ ID NO: 559 - DNA, 220 bp, Unknown
  Description of Unknown: 16S RNA Operational Taxonomic Unit polynucleotide
  Phylum: WS3; Class: PRR-12; Order: Sediment-1; Family: PRR-10
aaggcccgggaacgtattcaccgctgcctgctgatcagcgattactagcgattccgacttcatgcagtcgagttgcagactgcaatccgaactgagaccggtttttgggagttgcctccacctcgcggtatcggaaccctctgtaccggccattgtagcacgtgtgtagccccagacgtaagggccatgaggacttgacgtcatccccacccttcctccg

SEQ ID NO: 560 - DNA, 220 bp, Unknown
  Description of Unknown: 16S RNA Operational Taxonomic Unit polynucleotide
  Phylum: Proteobacteria; Class: Alphaproteobacteria; Order: Sphingomonadales; Family: Sphingomonadaceae
aagacccgggaacgtattcaccgcggcatgctgatccgcgattactagcgattccgccttcatgctctcgagttgcagagaacaatccgaactgagacaagttttggagattagctcaccgtcgccggttcgctgcccactgtacttgccattgtagcacgtgtgtagcccaacgcgtaagggccatgaggacttgacgtcatccccacttcctccggct

SEQ ID NO: 561 - DNA, 220 bp, Unknown
  Description of Unknown: 16S RNA Operational Taxonomic Unit polynucleotide
  Phylum: Proteobacteria; Class: Betaproteobacteria
aagacccgggaacgtattcaccgcggcaagctgatccgcgattactagcgattccgacttcatgcagtcgagttgcagactgcaatccggactacgatcggttttctgggattagctccccctcgcggttggcagcctctgtaccgaccattgtatgacgtgtgtagcctacccataagggccatgaggacttgacgtcatccccaccttcctccggttt

SEQ ID NO: 562 - DNA, 220 bp, Unknown
  Description of Unknown: 16S RNA Operational Taxonomic Unit polynucleotide
  Phylum: Firmicutes; Class: Bacilli; Order: Bacillales; Family: Bacillaceae
aaggcccgggaacgtattcaccgcggcatgctgatccgcgattactagcgattccggcttcatgcaggcgagttgcagcctgcaatccgaactgagagtggttttatgggattggctcagcctcgcggcttcgcgaccctttgtaccacccattgtagcacgtgtgtagcccaggtcataaggggcatgatgatttgacgtcatccccaccttcctccgg

SEQ ID NO: 563 - DNA, 220 bp, Unknown
  Description of Unknown: 16S RNA Operational Taxonomic Unit polynucleotide
  Phylum: Proteobacteria; Class: Betaproteobacteria
aagactcgggaacgtattcaccgcgacatgctgatccgcgattactagcgattccgacttcatgcagtcgagttgcagactgcaatccggactacgacgcgctttgagggattggctccaggtcgccccttggcaaccctctgtacgcgccattgtattacgtgtgaagccctacccataagggccatgaggacttgacgtcatccccaccttcctccgg

SEQ ID NO: 564 - DNA, 220 bp, Unknown
  Description of Unknown: 16S RNA Operational Taxonomic Unit polynucleotide
  Phylum: Verrucomicrobia; Class: Verrucomicrobiae; Order: Verrucomicrobiales
aaggcctgggaacgtattcacggcgccgtagctgatgcgccattactagcgattccagcttcatgtcggcgagttgcagccgacaatctgaactgagcccggttttttgggatttgctccacctgacggtctagcttccctttgtgccgggcattgtagtacgtgtgcagccctggccgtaagggccatcctgacttgacgtcatccccaccttcctccg

SEQ ID NO: 565 - DNA, 220 bp, Unknown
  Description of Unknown: 16S RNA Operational Taxonomic Unit polynucleotide
  Phylum: Acidobacteria; Class: Acidobacteria; Order: Acidobacteriales
aaggccggaacgtatccaccgcggcgtgctgatccgcgattactagcgattccaacttcatgcaggcgagttgcagcctgcaatccgaactgagaccgactttatccgattagctccaccttgcggtatcgcgacggtttgtgtcggccattgtagcacgtgtgtggccccagacataaaggccatgcggacttgacgtcatccccaccttcctccggtt

SEQ ID NO: 566 - DNA, 220 bp, Unknown
  Description of Unknown: 16S RNA Operational Taxonomic Unit polynucleotide
  Phylum: Acidobacteria; Class: Chloracidobacteria
aaggcccgggaacgtattcaccgcaacatgctgatttgcgattactagcgattccaacttcatggagtcgagttgcagactccaatccgaactgagaatggttttcgcgattagctcccccttgcgggattgcgacgttttgtaccatccattgtagcacgtgtgtagccctaagcataaaggccatgatgacttgacatcatccccaccttcctccgtt

SEQ ID NO: 567 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcacgcagtcgagttgcagactgcgatctgaactgagagacggtttttgggtagttggctccttatcgctaagtggcagccctttgtccgtcccattgtagcacgtgtgtagccctgggcataaaggccatgatgacctgacatcatcccccttccttcc

SEQ ID NO: 568 - DNA, 220 bp, Unknown
  Description of Unknown: 16S RNA Operational Taxonomic Unit polynucleotide
  Phylum: Proteobacteria; Class: Gammaproteobacteria; Order: Enterobacteriales; Family: Enterobacteriaceae
aaggcccggaacgtatcgaccgtaggcattctgatctacgattactagcgattccgacttcacggagtcgagttgcagactccgatccggactacgacgcactttatgaggtccgcttgctctcgcgaggtcgcttctctttgtatgcgccattgtagcacgtgtgtagccctactcgtaagggccatgatgacttgacgtcatccccaccttcctccag

SEQ ID NO: 569 - DNA, 220 bp, Unknown
  Description of Unknown: 16S RNA Operational Taxonomic Unit polynucleotide
aagacctgggaacgtattcaccgcggcgtgctgatccgcgattactagcgattccaacttcatgtagtcgagttgcagactacaatccgaactgagaacggttttttccgattggctccccctcgcggttgcaacgtttgtaccgtccattgtagcacgtgtgtagcccctggacataaaggccatgatgacttgacgtcatccccaccttctccggtta

SEQ ID NO: 570 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Hyphomicrobiaceae
aaggcccggacgtattcaccgcagcgtgctgatctgcgattactagcgattccaacttcatgtgctcgagttgcagagcacaatccgaactgagacggctttttgagatttgcgcaggattgctccattgcatcccactgtcaccgccattgtagcacgtgtgtagcccagcctgtaagggccatgaggacttgacgtcatccccacttctcgcggctta

SEQ ID NO: 571 - DNA, 220 bp, Unknown
  Description of Unknown: 16S RNA Operational Taxonomic Unit polynucleotide
  Phylum: Proteobacteria; Class: Alphaproteobacteria; Order: Caulobacterales; Family: Caulobacteraceae
aaggcccgggaacgtattcaccgcggcatgctgatccgcgattactagcgattccaacttcatgccctcgagttgcagaggacaatccgaactgagacgacttttagggatttaccctctgtagtcgccattgtagcacgtgtgtagcccaccccgtaagggccatgaggacttgacgtcatccccacttcctcggcttagcaccggcagtcctgttaga

SEQ ID NO: 572 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtagcgttgctgatctacgattactagcgattccagcttcatgcaggcgagttgcagcctgcaatccgaactgagagaaggttttgagattagcatcctgtcaccaggtagcagccctttgtccttcccattgtagcacgtgtgtagccctgggcataaaggccatgatgacttgacatcatcccctccttcctcgcg

SEQ ID NO: 573 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatggagtcgagttgcagactccaatctgaactgagagaaggttttgggattggctccttatcgctaagtggcagccctttgtccttcccattgtagcacgtgtgtagccctgggcataaaggccatgatgacttgacatcatcccctcctcacgtcgt

SEQ ID NO: 574 - DNA, 220 bp, Unknown
  Description of Unknown: 16S RNA Operational Taxonomic Unit polynucleotide
  Phylum: Actinobacteria; Class: Actinobacteria; Order: MC47
aagacccgggaacgtattcaccgcggcattgctgatccgcgattactagcaactccgccttcatgaaggcgagtttcagccttcaatccgaaccgggaccggctttttgggattcgctccccctcacgggtttgcagccctttgtaccggccaatgtagcacgtgtgtagcccagaacataaggggcatgatgacttgacgtcatccccacctcctccgg

SEQ ID NO: 575 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtagcgttgctgatctacgattactagcgattccagcttcatggagtcgagttgcagactccaatctgaactgagaagtggttttggattagcttccacatcactgtgttgcagccctttgtccactccattgtagcacgtgtgtagccctgggcataaaggccatgatgacttgacatcatcccctccttcctcacg

SEQ ID NO: 576 - DNA, 220 bp, Unknown
  Description of Unknown: 16S RNA Operational Taxonomic Unit polynucleotide
  Phylum: Cyanobacteria; Class: Nostocophycideae; Order: Nostocales; Family: Nostocaceae
aaggccggacgaatcgactgcagtatgctgacctgcaattactagcgattcctccttcacgcaggcgagttgcagcctgcgatctgaactgagctccggtttacgggatttgcttgcattcgcatgcttgctgccctctgtccggagcattgtagtacgtgtgtagcccaaggcgtaaggggcatgctgacttgacgtcatccccacttcctccggtttg

SEQ ID NO: 577 - DNA, 220 bp, Unknown
  Description of Unknown: 16S RNA Operational Taxonomic Unit polynucleotide
  Phylum: Proteobacteria; Class: Gammaproteobacteria; Order: Chromatiales; Family: Sinobacteraceae
aagacccgggaacgtattcaccgcgacatggctgattcgcgattactagcgattccgacttcacgcagtcgagttgcagactgcgatccggactacgaccggctttatgggattggctcccctcgcgggttggcaaccctttgtaccggccattgtagcacgtgtgtagccctggtcataagggccatgatgacttgacgtcatccccacttcctcccgg

SEQ ID NO: 578 - DNA, 220 bp, Unknown
  Description of Unknown: 16S RNA Operational Taxonomic Unit polynucleotide
  Phylum: Proteobacteria; Class: Gammaproteobacteria; Order: Chromatiales; Family: Sinobacteraceae
aaggcccgggaacgtattcaccgcagcgatgctgatctgcgattactagcgattccgacttcatggagtcgagttgcagactccaatccggactacgataagttttctgggattagctccctctcgcgagttggcttccctctgtacttaccattgtagcacgtgtgtagccctggtcataaaggccatgatgacttgacgtcatcccccttcctccggt

SEQ ID NO: 579 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Bradyrhizobiaceae
aaggcccgggaacgtattcaccgtggcgttctgatccacgattactagcgattccgccttcatgcactcgagttgcagagtgcaatccgaactgagacggctttttaggattagctccccctcgcggttcgctgcctttgtcaccgccattgtagcacgtgtgtagcccagcccgtaagggccatgaggacttgacgtcatccccaccttcctctcggct

SEQ ID NO: 580 - DNA, 220 bp, Unknown
  Description of Unknown: 16S RNA Operational Taxonomic Unit polynucleotide
  Phylum: Chloroflexi; Class: Chloroflexi; Order: Roseiflexales; Family: Kouleothrixaceae
aaggcccggtacgtattcgaccgcgccatggctgatacgcggttactagcaactccgccttcatgggggcgagttgcagcccccaatctgcactgggttcgtccttggcgattcgcatccgtttgcacggtagctgcgcgttgcgacgaacattgtagcgtgtgtgtcgccccaggcgtaagagccatgcggacttgacgtcatccccgccttcctcccc

SEQ ID NO: 581 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales; Family: Flexibacteraceae
aaggtccggaacgtattcaccgcgccatgctgatgcgcgattactagcgattccaacttcatgcaggcgagttgcagcctgcaatccgaactgagacgtactttgtgattggctcactgtcaccagcttgcaacactctgtatacgccattgtagcacgtgtgtagccctgggcgtaagggccatgatgacttgacgtcatcccctccttcctctctgct

SEQ ID NO: 582 - DNA, 220 bp, Unknown
  Description of Unknown: 16S RNA Operational Taxonomic Unit polynucleotide
  Phylum: Proteobacteria; Class: Alphaproteobacteria; Order: Sphingomonadales; Family: Sphingomonadaceae
aaggcctgggaacgtattcaccgcggcatgctgatccgcgattactagcgattccgccttcatgcactcgagttgcagagtgcaatccgaactgagacgacttttggagattagctcaccctcgcgagattgctgcccactgtagtcgccattgtagcacgtgtgtagcccagcgcgtaagggccatgaggacttgacgtcatccccacttctcgccatc

SEQ ID NO: 583 - DNA, 220 bp, Unknown
  Description of Unknown: 16S RNA Operational Taxonomic Unit polynucleotide
  Phylum: Acidobacteria; Class: Acidobacteria-5
aaggcccgggaacgtattcaccgctgcttgctgatcagcgattactagcgattccagcttcatggagtcgagttgcagactccaatccgaactgagatggttttttgagattggctccccctcgcgggtttgcgactctttgtgccaaccattgtagtacgtgtgtagcctggacataaaggccatgaggacttgacgtcatccccaccttcctccggtt

SEQ ID NO: 584 - DNA, 220 bp, Unknown
  Description of Unknown: 16S RNA Operational Taxonomic Unit polynucleotide
  Phylum: Verrucomicrobia; Class: Verrucomicrobiae; Order: Verrucomicrobiales
aaggcctgggaacgtattcacggcgccgtagctgatgcgccattactagcgattccggcttcatgtcgtcgagttgcagacgacaatctgaactgggcatggttttatgggatttgctccacctgacggtctagcttccctttgtgccatgcattgtagtacgtgtgcacgccctggaccggaaaggccatactgacttgacgtcatccccacttcctcc

SEQ ID NO: 585 - DNA, 220 bp, Unknown
  Description of Unknown: 16S RNA Operational Taxonomic Unit polynucleotide
aagtctagtaacatattcaccgcagcatgctgttctgcgattactagcgattccagcttcatatgggcgatttcagcccataatccgaactaagataatttttaaagatttgctccaattttaaatcattattgcctctcattgtaattatcattgtagcacgtgtgtagcccaactcataagggccatgaagacttgacgtcatcctaccttccttcac

SEQ ID NO: 586 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aagggtcccgggaacgtattcaccgtatcattgctgatatacgattactagcgattccagcttcacgcagtcgagttgcagactgcgatctgaactgagaaagagtttttgagattagcgccttgtcaccaagtggcagctctttgtctcttccattgtagcacgtgtgtagccctgggcataaaggccatgatgacttgacatcatcccctcttcctcg

SEQ ID NO: 587 - DNA, 220 bp, Unknown
  Description of Unknown: 16S RNA Operational Taxonomic Unit polynucleotide
  Phylum: Cyanobacteria; Class: S15B-MN24
aaggcctgggaacgtattcaccgtagcgtgctgatccacggttactagcgattccaacttcatgcaggcgagttgcagcctgcaatccgaactgagacatagtttatgggattcgctcactatcgctagcttgcagccctttgtctatgccattgtaggacgtgtgtagcccaagacgtaaggggcatgatgacttgacgtcgtcctcaccttcctccgg

SEQ ID NO: 588 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales; Family: Flexibacteraceae
aaggtccgggaacgtattcaccgcaacattgctgatttgcgattactagcgattccaacttcatgcaggcgagttgcagcctgcaatccgaactgagacattactttttgtgattggcttcctgtcaccaggtcgcaacactttgtatatgccattgtagcacgtgtgtagccctggacgtaagggccatgatgacttgaccgtcgtcccccttcctctc

SEQ ID NO: 589 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtagcattgctgatctacgattactagcgattccagcttcatgaggtcgagttgcagacctcaattcgaactgagacagatttttgagattagcatcctgttaccaggtagcaaccctttgtatctgccattgtagcacgtgtgtagccctgggcataaaggccatgatgacttgacatcatcccctctctcacgcct

SEQ ID NO: 590 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Phyllobacteriaceae
aacggcccgggaacgtattcaccgtggcacgctgatccacgattactagcgattccgacttcatgctctcgagttgcagagaacaatccgaactgagacggctttttgggattagctcctcctcgcggagtggctgcccattgtcaccgccattgtagcacgtgtgtagcccagcccgtaagggccatgatgacttgacgtcatccccacttcctccggc

SEQ ID NO: 591 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aaggcccgggacgtattcgaccgcagcaatgctgatctgcgattactagcaactccgacttcatggggtcgagttgcagaccccaatccgaactgagacaggcttttgtagattcgctccaccttacggtatcgcagctcattgtacctgccattgtagcacgtgtgcagcccaagacataaggggcatgatgacttgacgtcgtccccaccttcctccg

SEQ ID NO: 592 - DNA, 220 bp, Unknown
  Description of Unknown: 16S RNA Operational Taxonomic Unit polynucleotide
  Phylum: Gemmatimonadetes; Class: Gemmatimonadetes; Order: Gemmatimonadales; Family: Gemmatimonadaceae
aaggccgggaacgtattcaccgtggcgatgctgatccacgattactagcgattccagcttcatgccgtcgagttgcagacgacaatccgaactgaggatcggtttgggattgccttggcattgctgcctcggcccccactgtccgacccattgtagcacgtgtgtagccctagacgtaaggaccatgatgacttgacgtcgtccccacttctccggtttg

SEQ ID NO: 593 - DNA, 220 bp, Unknown
  Description of Unknown: 16S RNA Operational Taxonomic Unit polynucleotide
  Phylum: Proteobacteria; Class: Alphaproteobacteria; Order: Rhodospirillales; Family: Rhodospirillaceae
aaggcccgggacgtattcaccgcggcatgctgatccgcgattactagcgattccaacttcatgcactcgagttgcagagtgcaatccgaactgagacggctttttgagatcggctcaggctcgcgcccttgctccccattgtcaccgccattgtagcacgtgtgtagcccaacccgtaagggccatgaggacttgacgtcatccccgccttcctccggct

SEQ ID NO: 594 - DNA, 220 bp, Unknown
  Description of Unknown: 16S RNA Operational Taxonomic Unit polynucleotide
  Phylum: Proteobacteria; Class: Deltaproteobacteria; Order: Syntrophobacterales; Family: Syntrophobacteraceae
aaggcccgggaacgtattcaccgcggcatgctgatccgcgattactagcgattccgccttcatggagtcgagttgcagactccaatccgaactgagagcggctttttgggattggctccccctcgcgggttgcagccctttgtaccgcccattgtagcacgtgtgtagccccggacataagggccatgaggacttgacgtcatccccgccttcctcccgt

SEQ ID NO: 595 - DNA, 220 bp, Unknown
  Description of Unknown: 16S RNA Operational Taxonomic Unit polynucleotide
  Phylum: Proteobacteria; Class: Betaproteobacteria
aagacccgggaacgtattcaccgcgacatgctgatccgcgattactagcgattccggcttcatgcagtcgagttgcagactgcaatccggactacgaccggcttttctggattagctccccctcgcgggttggctgcctctgtaccggccattgtattacgtgtgaagccctacccataaagggccatgaggacttgacgtcatcccccaccttcctccg

SEQ ID NO: 596 - DNA, 220 bp, Unknown
  Description of Unknown: 16S RNA Operational Taxonomic Unit polynucleotide
  Phylum: Nitrospirae; Class: Nitrospira; Order: Nitrospirales; Family: Nitrospiraceae
aaggcccgggaacgtattcaccccggcgtgctgatccgggattactagcgattccgccttcacgaggtcgagttgcagacctcgatctgaactgaggccggttgcgattggctcccctcacgggtttgcagcgctttgtgccggccattgtagcacgtgtgtagccccaggcataaaggccatgctgacttgacgtcatccccacttcctccccgttctc

SEQ ID NO: 597 - DNA, 220 bp, Unknown
  Description of Unknown: 16S RNA Operational Taxonomic Unit polynucleotide
  Phylum: Gemmatimonadetes; Class: Gemmatimonadetes; Order: Gemmatimonadales; Family: Gemmatimonadaceae
aaggcccgggaacgtattcaccgtggcgtagctgatccacgattactagcgattccagcttcatggaggcgagttgcagcctccaatccgcactgagatcggctttacgggattggcttgctatcgctagctcgcaaccctttgtaccgatcattgtagcacgtgtgtagccctagacgtaaggaccatgatgacttgacgtcgtcccacttctccggtt

SEQ ID NO: 598 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Bradyrhizobiaceae
aaggcccgggaacgtattcaccgtggcgtgctgatccacgattactagcgattccaacttcatgggctcgagttgcagagcccaatccgaactgagacggctttttgagatttgcgaagggtcgccccttagcatcccattgtcaccgccattgtagcacgtgtgtagcccagcccgtaagggccatgaggacttgacgtccatcccccacctttcctcg

SEQ ID NO: 599 - DNA, 220 bp, Unknown
  Description of Unknown: 16S RNA Operational Taxonomic Unit polynucleotide
  Phylum: Proteobacteria; Class: Alphaproteobacteria; Order: Sphingomonadales; Family: Sphingomonadaceae
aaggcctgggaacgtattcaccgcggcatgctgatccgcgattactagcgattccgccttcatgctctcgagttgcagagaacaatccgaactgagacggcttttggagattagctcaccgtcgccggtttgctgcccactgtcaccgccattgtagcacgtgtgtagcccaagcgtaagggccatgaggacttgacgtcatccccacttcctccggctt

SEQ ID NO: 600 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Hyphomicrobiaceae
aaggcccgggaacgtattcaccgcagcgtgctgatctgcgattactagcgattccaacttcatgctctcgagttgcagagagcaatccgaactgagacggctttgagatttgcgcaggattgctccattgcatcccattgtcaccgcattgtagcacgtgtgtagcccaacctgtaagggccatgaggacttgacgtcatccccacttcctcgcggctta

SEQ ID NO: 601 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Microbacteriaceae
aaggcccgggaacgtattcaccgcagcgttgctgatctgcgattactagcgactccgacttcatgaggtcgagttgcagacctcaatccgaactgagaccggcttttgggattcgctccaccttacggtattgcagccctttgtaccggccattgtagcatgcgtgaagcccaagacataaggggcatgatgatttgacgtcatccccacttccccgacg

SEQ ID NO: 602 - DNA, 220 bp, Unknown
  Description of Unknown: 16S RNA Operational Taxonomic Unit polynucleotide
  Phylum: Proteobacteria; Class: Alphaproteobacteria; Order: Sphingomonadales; Family: Sphingomonadaceae
aaggcctgggaacgtattcaccgcggcatgctgatccgcgattactagcgattccgccttcatgctctcgagttgcagagaacaatccgaactgagacggctttttgggattagctcctcctcgcggagtggctgcccgttgtcaccgccattgtagcacgtgtgtagcccagcgcgtaagggccatgaggacttgacgtcatccccacctcctcccgtc

SEQ ID NO: 603 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcacgcagtcgagttgcagactgcgatctgaactgagaagaggtttttggggattgggcttcacatcgctgtgttgcagccctttgtcctccccattgtagcacgtgtgtagccctgggcataaaggccatgatgacttgacatcatcccctccttcctc

SEQ ID NO: 604 - DNA, 220 bp, Unknown
  Description of Unknown: 16S RNA Operational Taxonomic Unit polynucleotide
  Phylum: Acidobacteria; Class: Acidobacteria-5
aaggcccgggaacgtattcaccgctgcttgctgatcagcgattactagcgattccagcttcatggagtcgagttgcagactccaatccgaactgagaacggtttttgagattggctccctttgcaggtttgcgactcattgtgccgcccattgtagtacgtgtgtagccctggacataaaggccatgaggacttgacgtcatcccccttcctccggtttt

SEQ ID NO: 605 - DNA, 220 bp, Unknown
  Description of Unknown: 16S RNA Operational Taxonomic Unit polynucleotide
  Phylum: Armatimonadetes
aaggcccgggaacgtattcaccgcagttagctgacctgcggttactagcgattccggcttcacgcgggcgagttgcagcccgcgatccgaactgggccggctttgtggatttcgctcctccttgcggatcgcagccctctgtaccggccattgtagcatgtgtgaagccccaggcgtaagggccatgccgacttgacgtcgtccccaccttcctcccgcc

SEQ ID NO: 606 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Propionibacteriaceae
aaggcccgggaacgtattcaccgcagcgttgctgatctgcgattactagcgactccgacttcatggggtcgagttgcagacccaatccgaactgagactggcttttggattcgcttgaccttgcggtttgcagccctttgtaccagccattgtagcatgcgtgaagccctggacttaaggggcatgatgacttgacgtcatccccacttcctccgagttg

SEQ ID NO: 607 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Phyllobacteriaceae
aaggccggacgtattcaccgtggcatgctgatccacgattactagcgattccgacttcatgctctcgagttgcagagaacaatccgaactgagacggctttttgggattagctcctcctcgcggagtggctgcccactgtcaccgccattgtagcacgtgtgtagcccagcccgtaagggccatgatgacttgacgtcatccccacttcctccggcttat

SEQ ID NO: 608 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcacgcagtcgagttgcagactgcgatctgaactgagattacttttggttagcgccctgtcaccaggtggcagccctttgtagtaaccattgtagcacgtgtgtagccctgggcataaaggccatgatgacttgacatcatcccctccttctcgcgtctt

SEQ ID NO: 609 - DNA, 220 bp, Unknown
  Description of Unknown: 16S RNA Operational Taxonomic Unit polynucleotide
  Phylum: Gemmatimonadetes; Class: Gemmatimonadetes; Order: Gemmatimonadales; Family: Gemmatimonadaceae
aaggcccgggaacgtattcaccgtggcgtagctgatccacgattactagcgattccagcttcatgccctcgggttgcagaggacaatccgaactgaggacggttaggggattagctccgccttgcgactttgcgaccctctgtcccgtccattgtagcacgtgtgtagccctggacgtaaggaccatgatgacttgacgtcgtccccacttcctccggtt

SEQ ID NO: 610 - DNA, 220 bp, Unknown
  Description of Unknown: 16S RNA Operational Taxonomic Unit polynucleotide
  Phylum: Acidobacteria; Class: RB25
aaggcctgggaacgtattcaccgcggcatgctgatccgcgattactagcgattccaccttcatgcactcgagttgcagagtgcaatccgaactgagggcggctttttgggattggctccaccttgcggtctcgcagccctttgtaccgcccattgtagcacgtgtgtagccctggacataaaggccatgatgacttgacgtcatccccaccttcctccgg

SEQ ID NO: 611 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtagcgttgctgatctacgattactagcgattccagcttcatgcaggcgagttgcagcctgcaatctgaactgagagaggttttttgagatttggcattcctgtcaccaggtagcagccctttgtaccccccattgtacgcacgtgtgtagccctgggcataaaggccatgatgacttgacatcatcccctccttcct

SEQ ID NO: 612 - DNA, 220 bp, Unknown
  Description of Unknown: 16S RNA Operational Taxonomic Unit polynucleotide
  Phylum: Chloroflexi; Class: Chloroflexi
aaggcccgggtacgtattcaccgcgccatggctgatacgcggttactagcaactccgccttcacgggggcgagtttcagcccccgatctgcactgggccagcgttttacgatttgcatcctcttgcgaggtagcggcgctctgtcgctggcattgtagcgtgtgtgtcgccccaggcgtaagagccatgcggacttgacgtcatccccgccttcctccgg

SEQ ID NO: 613 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatggagtcgagttgcagactccaatctgaactgagaggtcgttttttgggattggctcccttatcgctaagtggcagcctttgtacgcccattgtagcacgtgtgtagccctgggcataaaggccatgatgacttgaccatccatcccctccttcctc

SEQ ID NO: 614 - DNA, 220 bp, Unknown
  Description of Unknown: 16S RNA Operational Taxonomic Unit polynucleotide
  Phylum: Acidobacteria; Class: Chloracidobacteria
aagacccgggaacgtattcaccgcaacatgctgatttgcgattactagcgattccaacttcatgaagtcgagttgcagacttcaatccgaactgagaccggtttagcgattggctcccccttgcgggattgcgacgttttgtaccggccattgtagcacgtgtgtacgccctgaacataaaggccatgatgacttgacatcactccccaccttcctccgg

SEQ ID NO: 615 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
gaggtccgggaacgtattcaccgtatcattgctgatatacgattactagcgattccagcttcatggagtcgagttgcagactccaatctgaactgagagacgttttttgggattggcttcatatcgctatgttgcagccctttgtacgccccattgtagcacgtgtgtagccctgggcataaaggccatgatgacttgacatcatcccctccttcctcac

SEQ ID NO: 616 - DNA, 220 bp, Unknown
  Description of Unknown: 16S RNA Operational Taxonomic Unit polynucleotide
  Phylum: Proteobacteria; Class: Deltaproteobacteria; Order: Desulfuromonadales; Family: Geobacteraceae
aaggcccgggaacgtattcaccgcggcatgctgatccgcgattactagcgattccaacttcatggagtcgagttgcagactccaatccgaactgagaccggctttatgagattagcttgacctcgcggtttcgcaactctttgtaccggccattgtagcacgtgtgtagccctggacataagggccatgaggacttgacgtcatccccaccttcctccgt

SEQ ID NO: 617 - DNA, 220 bp, Unknown
  Description of Unknown: 16S RNA Operational Taxonomic Unit polynucleotide
  Phylum: Firmicutes; Class: Bacilli; Order: Bacillales; Family: Paenibacillaceae
aagacccgggaacgtattcaccgcggcatgctgatccgcgattactagcaattccgacttcatgcaggcgagttgcagcctgcaatccgaactgtagaccggctttggtaggattagctccgcctcgcggcttcgcgacccgttgtaccggccattgtagtacgtgtgtagcccagggtcataaggggcatgatgatttgacgtcatcccccgccttcct

SEQ ID NO: 618 - DNA, 220 bp, Unknown
  Description of Unknown: 16S RNA Operational Taxonomic Unit polynucleotide
  Phylum: Bacteroidetes; Class: Flavobacteria; Order: Flavobacteriales; Family: Flavobacteriaceae
aaggcccggaacgtattcaccgcgccatggctgatgcgcgattactagcgattccagcttcatagagtcgagttgcagactccaatccgaactgagaccggctttcgagatttgcatcacatcgctgtgtagctgccctctgtaccggccattgtattacgtgtgtggcccaaggcgtaagggccgtgatgatttgacgtcatccccactcctctctact

SEQ ID NO: 619 - DNA, 220 bp, Unknown
  Description of Unknown: 16S RNA Operational Taxonomic Unit polynucleotide
  Phylum: Gemmatimonadetes; Class: Gemmatimonadetes; Order: Gemmatimonadales; Family: Gemmatimonadaceae
aaggcccggaacgtattcaccgtggcgtagctgatccacgattactagcgattccagcttcatggaggcgagttgcagcctccaatccgcactgaggtcggctttatgggattggcttgctatcgctagctcgcaaccctttgtaccggccattgtagcacgtgtgtagccctagacgtaaggaccatgatgacttgacgtcgtccccacttcctccggt

SEQ ID NO: 620 - DNA, 220 bp, Unknown
  Description of Unknown: 16S RNA Operational Taxonomic Unit polynucleotide
  Phylum: Chloroflexi; Class: Chloroflexi; Order: Roseiflexales; Family: Kouleothrixaceae
aaggcccgggtacgtattcaccgcgccatggctgatacgcggttactagcaactccgccttcatgggggcgagttgcagcccccaatctgcactgggtccgtccttggcgattcgcatctccttgcggagtagctgcgcgttgcgacggacattgtagcgtgtgtgtcgccccaggcgtaagagccatgcggacttgacgtcatcccgcttctccccaag

SEQ ID NO: 621 - DNA, 220 bp, Unknown
  Description of Unknown: 16S RNA Operational Taxonomic Unit polynucleotide
  Phylum: Gemmatimonadetes; Class: Gemmatimonadetes; Order: Gemmatimonadales; Family: Gemmatimonadaceae
gaggcccgggaacgtattcaccgtggcgtagctgatccacgattactagcgattccagcttcatggaggcgagttgcagcctccaatccgcactgaggccggctttggggattggctcatgcttgcgcatttgcgacccgctgtaccggccattgtagcacgtgtgtagccctagacgtaaggaccatgatgacttgacgtcgtccccacttcctccggt

SEQ ID NO: 622 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Mycobacteriaceae
aaggcccgggaacgtattcaccgcagcgttgctgatctgcgattactagcgactccgacttcatggggtcgagttgcagaccccaatccgaactgagaccggctttcaagggattcgctccacctcgcggattcgcagccctttgtaccggccattgtagcatgtgtgaagccctggacataaggggcatgatgacttgacgtcatcccccttcctccga

SEQ ID NO: 623 - DNA, 220 bp, Unknown
  Description of Unknown: 16S RNA Operational Taxonomic Unit polynucleotide
  Phylum: Proteobacteria; Class: Alphaproteobacteria
aaggcctgggaacgtattcaccgcagcctgctgttctgcgattactagcgattccaccttcatgcactcgagttgcagagtgcaatctgaactggggcggctttttgggattagcttactctcgcgagctagctgcccactgtcaccgccattgtagcacgtgtgtagcccagggtgtaagggccatgaggacttgacgtcatccccaccttcctccggc

SEQ ID NO: 624 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgcagcattgctgatctgcgattactagcgattccagcttcatgcaggcgagttgcagcctgcaatctgaactgagagagggtttttgggagttggcgccttatcgctaagtggctgccctttgtccctcccattgtagcacgtgtgtagccccgggcgactaaagaccatgatgacttgacatcatcccctccttcct

SEQ ID NO: 625 - DNA, 220 bp, Unknown
  Description of Unknown: 16S RNA Operational Taxonomic Unit polynucleotide
  Phylum: Actinobacteria; Class: Actinobacteria; Order: Solirubrobacterales
aaggtccgggaacgtattcaccgcggcgttgctgatccgcgattactagcaactccaccttcatggaggcgaatttcagcctccaatccgaaccgagaccaactttttgggattcgctccacctcgcggtatcgcaaccctctgtaccggccaatgtagcacgtgtgtagccctggacataaggggcatgatgacttgacgtcatccccaccttcctccg

SEQ ID NO: 626 - DNA, 220 bp, Unknown
  Description of Unknown: 16S RNA Operational Taxonomic Unit polynucleotide
  Phylum: Acidobacteria; Family: Koribacteraceae
aaggcccgggaacgtattcaccgcggcgttctgatccgcgattactagcgattccagcttcatggagtcgagttgcagactccaatccggactgaggatggctttttccgattagctcccttcacaggtttgcgacggtttgtaccacccattgtagcacgtgtgtagccctggacataaaggccatgaggacttgacgtcatccccacttcctccccgt

SEQ ID NO: 627 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccggacgtattcaccgtatcattgctgatatacgattactagcgattccagcttcatggagtcgagttgcagactccaatctgaactgagaggcgttttgggattagcttcacgtcgccgtgttgcagccctttgtacgccccattgtagcacgtgtgtagccctgggcataaaggccatgatgacttgacatcatcccctccttcctcacgtct

SEQ ID NO: 628 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Hyphomicrobiaceae
aaggcccgggaacgtattcaccgcagcgtgctgatctgcgattactagcgattccgacttcatggggtcgagttgcagacccaatccgaactgagacggcttttgtgattagctcccattgctgggtggctgccactgtcaccgccattgtagcacgtgtgtagcccagcccgtaagggccatgatgacttgacgtcatccccaccttcctccggcttat

SEQ ID NO: 629 - DNA, 220 bp, Unknown
  Description of Unknown: 16S RNA Operational Taxonomic Unit polynucleotide
  Phylum: Acidobacteria; Class: PAUC37f
aaggcccgggaacgtattcaccgcggcatgctgatccgcgattactagcgattccagcttcatgcagtcgagttgcagactgcaatccgaactgagaacggttttgggattggctcccctcgcgggtttgcaaccctttgtaccgcccattgtagcacgtgtgtagccctggacataaaggccatgaggacttgacgtcatccccacttcctccggctta

SEQ ID NO: 630 - DNA, 220 bp, Unknown
  Description of Unknown: 16S RNA Operational Taxonomic Unit polynucleotide
  Phylum: Acidobacteria; Class: Acidobacteria; Order: Acidobacteriales
aaggcccgggaacgtattcaccgcggcatgctgatccgcgattactagcgattccgacttcatgcaggcgagttgcagcctacaatccgaactgagaccggctttttccgattagctccccctcgcgggctcgcgacggtttgtaccggccattgtagcacgtgtgtagccctggacataaaggccatgctgacttgacgtcatccccacttcctccccg

SEQ ID NO: 631 - DNA, 220 bp, Unknown
  Description of Unknown: 16S RNA Operational Taxonomic Unit polynucleotide
  Phylum: Proteobacteria; Class: Alphaproteobacteria; Order: Caulobacterales; Family: Caulobacteraceae
aaggcccgggaacgtattcaccgcggcatgctgatccgcgattactagcgattccaacttcatgcactcgagttgcagagtgcaatccgaactggagtacgactttttagggattggctcccctcgcgggattgcagccctctgtagtcgccattgtagcacgtgtgtagcccaccttgtaagggccatgaggacttgacgtcatccccacccttcctcc

SEQ ID NO: 632 - DNA, 220 bp, Unknown
  Description of Unknown: 16S RNA Operational Taxonomic Unit polynucleotide
  Phylum: Proteobacteria; Class: Gammaproteobacteria; Order: Xanthomonadales; Family: Xanthomonadaceae
aaggcccgggaacgtattcaccgcggcaatgctgatccgcgattactagcgattccgacttcacgaagtcgagttgcagacttcgatccggactaagatggggtttctggttggctccggctcgcgccttggcgaccctctgtcccaccattgtagtacgtgtgtagccctggtcgtaagggccatgatgacttgacgtcatccccaccttcctccggtt

SEQ ID NO: 633 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
gaggtccgggaacgtattcaccgtatcattgctgatatacgattactagcgattccagcttcatgaggtcgagttgcagacctcaatccgaactgagatagagtttttgagattagcagcttgttaccaagtagcagccctttgtctctaccattgtagcacgtgtgtagccctgggcataaaggccatgatgacttgacatcatcccctccttcctcgc

SEQ ID NO: 634 - DNA, 220 bp, Unknown
  Description of Unknown: 16S RNA Operational Taxonomic Unit polynucleotide
  Phylum: Acidobacteria
aaggcccgggaacgtattcaccgcagcgtgctgatctgcgattactagcgattccagcttcacggagtcgagttgcagactccgatccggactgggccggctttttccgattggctcccctcacgggtttgcgacggtttgtaccgaccattgtagcacgtgtgtagccctggacataaaggccatgaggacttgacgtcatcccccttcctccccttat

SEQ ID NO: 635 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aaggcccgggaacgtattcaccgcagcgttgctgatctgcgattactagcgactccgacttcatggggtcgagttgcagaccccaatccgaactgagaccggcttttgggattcgctccacctcacggtatcgcagctcattgtacctgccattgtagcacgtgtgcagcccaagacataaggggcatgatgacttgacgtcgtccccaccttcctccga

SEQ ID NO: 636 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Thermomonosporaceae
aaggcccgggaacgtattcaccgcagcgttgctgatctgcgattactagcgactccgacttcatggggtcgagttgcagaccccaatccgaactgagaccggctttccgggattcgctccacctcacggtttcgcagccctttgtaccggccattgtagcatgtttgcagcccaagacataaggggcatgatgacttgacgtcatcccccttcctccggt

SEQ ID NO: 637 - DNA, 220 bp, Unknown
  Description of Unknown: 16S RNA Operational Taxonomic Unit polynucleotide
  Phylum: Verrucomicrobia; Class: Verrucomicrobiae; Order: Verrucomicrobiales
aaggcctgggaacgtattcacggcgccgtagctgatgcgccattactagcgattccagcttcatgccgtcgagttgcagacgacaatctgaactgggcccggttttggggatttgcttccatcttacgatcttgcttccctctgtgccgggcattgtagtacgtgtgcagccctggccgtaagggccatcctgacttgacgtcatccccacctttcctcc

SEQ ID NO: 638 - DNA, 220 bp, Unknown
  Description of Unknown: 16S RNA Operational Taxonomic Unit polynucleotide
  Phylum: Proteobacteria; Class: Deltaproteobacteria; Order: Myxococcales; Family: Haliangiaceae
aaggcccgggaacgtattcaccgcggcatgctgatccgcgattactagcgattccgacttcatgcagtcgagttgcagactgcaatccgaactgggaccggttttttgagattggcgtgcctttgcaggttagcaaccctttgtaccggccattgtagtacgtgtgtagccctgggcataagggccatgaggacttgacgtcatccccaccttcctccga

SEQ ID NO: 639 - DNA, 220 bp, Unknown
  Description of Unknown: 16S RNA Operational Taxonomic Unit polynucleotide
  Phylum: Verrucomicrobia; Class: Opitutae; Order: Opitutales; Family: Opitutaceae
aaggcccgggaacgtattcacggcgtcgtagctgatacgccattactagcgattccggcttcatgcagtcgagttgcagactgcaatctgaactgggctcggtttggatttgctcacctcgcggtcttgcgtcctctgtaccgagcattgtagcacgtgtgcagcccaggccgtaagggccatcctgacttgacgtcatccccacttcccaccctcagag

SEQ ID NO: 640 - DNA, 220 bp, Unknown
  Description of Unknown: 16S RNA Operational Taxonomic Unit polynucleotide
  Phylum: Acidobacteria; Class: Solibacteres; Order: Solibacterales; Family: Solibacteraceae
aaggcccgggaacgtattcacggcatcgttctgatacgccattactagcgattccagcttcacgcaggcgagttgcagcctgcgatccgaactgaggacggttttttgcggattggcttcccctcgcgggttcgcagcgcattgtaccgcccattgtagcacgtgtgtagccctggacataaaggccatgatgacttgacatcatccccacttcctccaa

SEQ ID NO: 641 - DNA, 220 bp, Unknown
  Description of Unknown: 16S RNA Operational Taxonomic Unit polynucleotide
  Phylum: Verrucomicrobia; Class: Verrucomicrobiae; Order: Verrucomicrobiales
aaggcctgggaacgtattcacggcgccgtagctgatgcgccattactagcgattccggcttcatgccgtcgagttgcagacgacaatctgaactgggcccggttttctggtttgctccacctgacggtcttgcttccctctgtaccgggcattgtagtacgtgtgcagccctggccgtaagggccatactgacttgacgtcatccccacttcctcccgat

SEQ ID NO: 642 - DNA, 220 bp, Unknown
  Description of Unknown: 16S RNA Operational Taxonomic Unit polynucleotide
  Phylum: Proteobacteria; Class: Gammaproteobacteria; Order: Chromatiales; Family: Sinobacteraceae
aagacccgggaacgtattcaccgcagcaatgctgatctgcgattactagcgattccgacttcatggagtcgagttgcagactccaatccggactacgacagattttctgggattagctccccgtcgccgtggctccctctgtatctgccattgtagcacgtgtgtagccctggtcataaaggccatgatgacttgacgtcatccccaccttcctccggtt

SEQ ID NO: 643 - DNA, 220 bp, Unknown
  Description of Unknown: 16S RNA Operational Taxonomic Unit polynucleotide
  Phylum: Gemmatimonadetes; Class: Gemmatimonadetes; Order: Gemmatimonadales; Family: Gemmatimonadaceae
aagggcccgggaacgtattcaccgtggcgtagctgatccacgattactagcgattccagcttcatggaggcgagttgcagcctccaatccgcactgaggccggctttgaggattggctcacgcttgcgcgcttgcgacccgctgtaccggccattgtagcacgtgtgtagccctagacgtaaggaccatgatgacttgacgtcgtccccaccttcctccg

SEQ ID NO: 644 - DNA, 220 bp, Unknown
  Description of Unknown: 16S RNA Operational Taxonomic Unit polynucleotide
  Phylum: Armatimonadetes; Class: Armatimonadia; Order: Armatimonadales; Family: Armatimonadaceae
acaaggcccgggaacgtattcaccgcagtttcgctgacctgcggttactagcgattccagcttcatgcaggcgagttgcagcctgcaatccgaactgagatgcctttttgagattcgctcaccctcgcggggtcgctcccctttgtaggcaccattgtagcatgtgtgaagccccaggcgtaagggccatgccgacttcgacgtcatccccgcttcctcc

SEQ ID NO: 645 - DNA, 220 bp, Unknown
  Description of Unknown: 16S RNA Operational Taxonomic Unit polynucleotide
  Phylum: Proteobacteria; Class: Gammaproteobacteria; Order: Pseudomonadales; Family: Moraxellaceae
aaggcccgggaacgtattcaccgcggcattctgatccgcgattactagcgattccgacttcatggagtcgagttgcagactccaatccggactacgatcggctttttgagattagcatcctatcgctagtagcaacccctttgtaccgaccattgtagcacgtgtgtagccctgggtcggtaaggggccatgatgacttgacgtcgtccccgccttcctc

SEQ ID NO: 646 - DNA, 220 bp, Unknown
  Description of Unknown: 16S RNA Operational Taxonomic Unit polynucleotide
  Phylum: Proteobacteria; Class: Gammaproteobacteria; Order: Xanthomonadales; Family: Xanthomonadaceae
aaggcccggaacgtattcaccgcagcaatgctgatctgcgattactagcgattccgacttcatggagtcgagttgcagactccaatccggactgagatagggtttctgggattggcttgccctcgcgggtttgcagccctctgtccctaccattgtagtacgtgtgtagccctggccgtaagggccatgatgacttgacgtcatcccccttcctccggtg

SEQ ID NO: 647 - DNA, 220 bp, Unknown
  Description of Unknown: 16S RNA Operational Taxonomic Unit polynucleotide
  Phylum: Proteobacteria; Class: Betaproteobacteria
aaggcccgggaacgtattcaccgcgacatgctgatccgcgattactagcgattccgacttcatgctctcgagttgcagagaacaatccggactacgaccggctttctgggattggctcccctcgcgggttggcaaccctctgtaccgaccattgtatgacgtgtgaagccctacccataagggccatgaggacttgacgtcatccccaccttcctccggc

SEQ ID NO: 648 - DNA, 220 bp, Unknown
  Description of Unknown: 16S RNA Operational Taxonomic Unit polynucleotide
  Phylum: Acidobacteria; Class: Chloracidobacteria
aaggcccgggaacgtattcaccgcggcgttctgatccgcgattactagcgattccagcttcatgaagtcgagttgcagacttcaatccgaactgagaccggtttttgcgattaactccccctcgcgggatcgtaacgtttgtaccggccattgtagcacgtgtgtagccctaagcataaaggccatgatgacttgacatcatccccaccttcctccgttt

SEQ ID NO: 649 - DNA, 220 bp, Unknown
  Description of Unknown: 16S RNA Operational Taxonomic Unit polynucleotide
  Phylum: Proteobacteria; Class: Deltaproteobacteria; Order: Myxococcales
aaggcccgggaacgtattcacccctgccatgctgatcagggattactagcgattccgccttcatggagtcgagttgcagactccaatccgtactgaggtcggttttttggttggctccacctcgcggcttcgcagccctttgtaccgaccattgtagcacgtgtgtagccctggacataggggccatgaggacttgacgtcatccccaccttcctccgac

SEQ ID NO: 650 - DNA, 220 bp, Unknown
  Description of Unknown: 16S RNA Operational Taxonomic Unit polynucleotide
  Phylum: Acidobacteria; Class: Chloracidobacteria
gagacccgggaacgtattcaccgcggcgtgctgatccgcgattactagcgattccaacttcatggagtcgagttgcagactccaatccgaactgagaccggctttttccgattggctccctctcgcgagttcgcagcggtttgtaccggccattgtagcacgtgtgtagccctggacatagaggccatgatgacttgacgtcatccccaccttcctccgg

SEQ ID NO: 651 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Microbacteriaceae
aaggcccgggaacgtattcaccgtggcgttgctgatccacattactagcgactccgacttcatgaggtcgagttgcagacctcaatccgaactgagaccggctttttgggattcgctccaccttacggtattgcagccctttgtaccggccattgtagcatgcgtgaagcccaagacataaggggcatgatgatttgacgtcatccccactcctccgagt

SEQ ID NO: 652 - DNA, 220 bp, Unknown
  Description of Unknown: 16S RNA Operational Taxonomic Unit polynucleotide
  Phylum: Proteobacteria; Class: Deltaproteobacteria; Order: Myxococcales; Family: Cystobacteraceae
aaggcccgggaacgtattcaccgcggcgtgctgatccgcgattactagcgattccgccttcatggagtcgagttgcagactccaatctgaactgagaccggttttatgcgattagctccccctcgcgggttggcgacgcgttgtaccggccattgtagcacgtgtgtagccctggtcataaaggccatgaggacttgacgtcatcccacctccttcctct

SEQ ID NO: 653 - DNA, 220 bp, Unknown
  Description of Unknown: 16S RNA Operational Taxonomic Unit polynucleotide
  Phylum: Proteobacteria; Class: Gammaproteobacteria; Order: Chromatiales; Family: Sinobacteraceae
aaggacccgggaacgtattcaccgcagcaatgctgatctgcgattactagcgattccgacttcatggagtcgagttgcagactccaatccggactacgataagttttctgggattagctcccgctcgcgcgttggcttccctctgtacttaccattgtagcacgtgtgtagccctggtcataaaggccatgatgacttgacgtcatccccaccttcctcc

SEQ ID NO: 654 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatggagtcgagttgcagactccaatctgaactgagaaagggttttgagattagcgccttgttgccaagtggcagctctttgtcccttccattgtagcacgtgtgtagccctgggcataaaggccatgatgacttgaccatccaatcccctccttcctc

SEQ ID NO: 655 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatggagtcgagttgcagactccaatctgaactgagaggcgtttttgggatttaggccttcacatcactgtgttgcagccctttgtacgccccattgtagcacgtgtgtagccctgggcataaaggccatgatgacttgacatcatcccctccttcctc

SEQ ID NO: 656 - DNA, 220 bp, Unknown
  Description of Unknown: 16S RNA Operational Taxonomic Unit polynucleotide
  Phylum: Firmicutes; Class: Bacilli; Order: Bacillales; Family: Bacillaceae
aaggcccgggaacgtattcaccgcggcatgctgatccgcgattactagcgattccggcttcatgtaggcgagttgcagcctacaatccgaactgagaatggtttttatgggtattggctcgacctcgcggctttgctgccctttgtaccatccattgtagcacgtgtgtagcccaggtcataaggggcatgatgatttgacgtcatccccaccttcctcc

SEQ ID NO: 657 - DNA, 220 bp, Unknown
  Description of Unknown: 16S RNA Operational Taxonomic Unit polynucleotide
  Phylum: Proteobacteria; Class: Deltaproteobacteria
aaggcccgggaacgtattcaccccggcgtgctgatccgggattactagcgattccaacttcatggagtcgagttgcagactccaatctgaactgaggcaggtttttgagattggcttcaacttgcgttgtcgcaaccctttgtaccggccattgtagcacgtgtgtagccctgggcataagggccatgaggacttgacgtcatccccaccttctccgact

SEQ ID NO: 658 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Burkholderiaceae
aagacccgggaacgtattcaccgcggcatgctgatccgcgattactagcgattccagcttcacgcagtcgagttgcagactgcgatccggactacgatcggttttctgggattggctccgcctcgcggcttggcaaccctctgtacccaccattgtatgacgtgtgaagccctacccataagggccatgaggacttgacgtcatcccaccttcctccggt

SEQ ID NO: 659 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtagcgttgctgatctacgattactagcgattccagcttcatggagtcgagttgcagactccaatctgaactgagaagtggttttgggagttagcttcacatcactatgttgcagccctttcgttccactccattgtagcacgtgtgtagccctgggcgataaaggccatgatgacttgacatcatcccctccttcct

SEQ ID NO: 660 - DNA, 220 bp, Unknown
  Description of Unknown: 16S RNA Operational Taxonomic Unit polynucleotide
  Phylum: Acidobacteria; Class: iii1-8; Order: 32-20
aaggcccgggaacgtattcaccgcggcgtgctgatccgcgattactagcgattccagcttcatggggtcgagttgcagaccccaatccgaactgagaccggcttttagcgatttgctcgacttgcgttttcgcgacgctctgtaccggccattgtagcacgtgtgtagccctggacataaaggccatgaggacttgacgtcatccccaccttcctccggt

SEQ ID NO: 661 - DNA, 220 bp, Unknown
  Description of Unknown: 16S RNA Operational Taxonomic Unit polynucleotide
  Phylum: Firmicutes; Class: Bacilli; Order: Bacillales; Family: Paenibacillaceae
aagacccgggaacgtattcaccgcggcatgctgatccgcgattactagcaattccgacttcatgcaggcgagttgcagcctgcaatccgaactgagaccggcttttttaggattagctccacctcgcggcttcgcagcccgttgtaccggccattgtagtacgtgtgtagcccaggtcataaggggcatgatgatttgacgtcatccccaccttcctccg

SEQ ID NO: 662 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Hyphomicrobiaceae
aaggcccgggaacgtattcaccgcagcgtgctgatctgcgattactagcaattccgacttcatgcaccccgacgttgcagagtgcaatccgaactgagacggcttttagggattagcatcacatcgctgtgtagcaaccctctgtcaccgcccattgtagcacgtgtgtagcccagcccgtaagggccatgaagacttgacgtcatccccaccttcctcc

SEQ ID NO: 663 - DNA, 220 bp, Unknown
  Description of Unknown: 16S RNA Operational Taxonomic Unit polynucleotide
  Phylum: Gemmatimonadetes; Class: Gemmatimonadetes; Order: Gemmatimonadales; Family: Gemmatimonadaceae
aaggcccgggaacgtattcaccgtggcgatgctgatccacgattactagcgattccagcttcatgccgtcgagttgcagacgacaatccgaactgaggccggttgggattgcctcggcattgctgcctcggccccctttgtcccagccattgtagcacgtgtgtagccctagacgtaaggaccatgatgacttgacgtcgtcccaccttcctccggtttg

SEQ ID NO: 664 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Comamonadaceae
aagacccgggaacgtatcaccgcgacattctgatccgcgattactagcgattccgacttcacgcagtcgagttgcagactgcgatccggactacgactggctttatgggattggctccccctcgcgggttggcaaccctctgtaccagccattgtatgacgtgtgtagccccacctataagggccatgaggacttgacgtcatccccaccttcctccggt

SEQ ID NO: 665 - DNA, 220 bp, Unknown
  Description of Unknown: 16S RNA Operational Taxonomic Unit polynucleotide
  Phylum: TM7; Class: TM7-3; Order: EW055
aagatcagtgacgtattcaccgcaatttgctgacttgcgattactagcgattccggcttcaaagaggcgagtttcagcctcttatccgaactgggacaagctttggtgcgatttgctccacatcactgcttcgctgcgcattgtacttgccattgtatcgtgtttctagcccaggcgtaagggtaatactgacctgacatcatccctccttccttcccta

SEQ ID NO: 666 - DNA, 220 bp, Unknown
  Description of Unknown: 16S RNA Operational Taxonomic Unit polynucleotide
  Phylum: Proteobacteria; Class: Alphaproteobacteria; Order: Sphingomonadales; Family: Sphingomonadaceae
aaggcccgggaacgtattcaccgcggcatgctgatccgcgattactagcgattccgccttcatgctctcgagttgcagagaacaatccgaactgagacaacttttggagattagctaccctcgcgaggttgctgcccactgtagttgccattgtagcacgtgtgtagcccagcgcgtaagggccatgaggacttgacgtcatccccacttcctccggctt

SEQ ID NO: 667 - DNA, 220 bp, Unknown
  Description of Unknown: 16S RNA Operational Taxonomic Unit polynucleotide
  Phylum: Proteobacteria; Class: Deltaproteobacteria; Order: Myxococcales
aaggcccgggaacgtattcaccgctgccatgctgatcagcgattactagcgattccgacttcaaggagtcgagttgcagactcctatctgtactgaggtcacttttttgagattggctccctctcgcgagttcgctaccctttgtatcgaccattgtagcacgttttgtagccctggacataagggccatgatgacttgacgtcatccccaccttcctcg

SEQ ID NO: 668 - DNA, 220 bp, Unknown
  Description of Unknown: 16S RNA Operational Taxonomic Unit polynucleotide
  Phylum: Proteobacteria; Class: Betaproteobacteria; Order: Burkholderiales
aagacccgggaacgtattcaccgcggcaagctgatccgcgattactagcgattccgacttcacgcagtcgagttgcagactgcgatccgggacacgaccggtttctgggattgggctccccctcgcgggttggcagccctctgtaccggccattgtatgacgtgtgtagccctacccataagggccatgaggacctgacgtcatccccaccttcctccgg

SEQ ID NO: 669 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggcccgggaacgtattcaccgtatcattgctgatatacgattactagcgattccagcttcatgcaggcgagttgcagcctgcaatctgaactgagaagagttttgggattagctccttatcgctaagtggcagccctttgtactctccattgtagcacgtgtgtagccctgggcataaaggccatgatgacttgacatcatcccctccttctcgcgtc

SEQ ID NO: 670 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aaggcccggaacgtattcggaccgcgagcaatgctgatctgcgattactagcaactccgacttcatggggtcgagttgcagaccccaatccgaactgagacaggcttttttgagattgctccacctcacggtatcgcagctcattgtacctgccattgtagcacgtgtgcagcccaagacataaggggcatgatgacttgacgtcgtccccaccttcctc

SEQ ID NO: 671 - DNA, 220 bp, Unknown
  Description of Unknown: 16S RNA Operational Taxonomic Unit polynucleotide
  Phylum: Proteobacteria; Class: Betaproteobacteria; Order: Burkholderiales
gagacccgggaacgtattcaccgcgacatgctgatccgcgattactagcgattccgacttcatgcagtcgagttgcagactgcaatccggactacgactggttttctgggattggctcccccttgcgggttggcagccctctgtaccagccattgtatgacgtgtgaagccctacccataagggccatgaggacttgacgtcatccccacttcctccggt

SEQ ID NO: 672 - DNA, 220 bp, Unknown
  Description of Unknown: 16S RNA Operational Taxonomic Unit polynucleotide
  Phylum: Cyanobacteria; Class: Synechococcophycideae; Order: Synechococcales; Family: Acaryochloridaceae
aaggcccgggaacgtattcaccgcagtatgctgacctgcgattactagcgattccgccttcatgcaggcgagttgcagcctgcaatctgaactgagccatggtttacgagattagcttgtactcgcgcacttgcaactctctgtccatagcattgtagtacgtgtgtagcccaggacgtaaggggcatgctgacttgacgtcatcccactcctccggttt

SEQ ID NO: 673 - DNA, 220 bp, Unknown
  Description of Unknown: 16S RNA Operational Taxonomic Unit polynucleotide
  Phylum: Proteobacteria; Class: Alphaproteobacteria; Order: Rhodospirillales; Family: Rhodospirillaceae
aaggtccgggaacgtattcaccgcggcattgctgatccgcgattactagcgattccaccttcatgcactcgagttgcagagtgcaatccgaactgggacggctttttgggatcggctccggctcgcaccttcgcatcccactgtcaccgccattgtagcacgtgtgtagcccagcccgtaagggccatgaggacttgacgtcatccccacttcctccggc

SEQ ID NO: 674 - DNA, 220 bp, Unknown
  Description of Unknown: 16S RNA Operational Taxonomic Unit polynucleotide
  Phylum: Bacteroidetes; Class: Flavobacteria; Order: Flavobacteriales; Family: Flavobacteriaceae
agggcccgggaacgtattcaccgcgccatggctgatgcgcgattactagcgattccagcttcatagagtcgagttgcagactccaatccgaactgagaccggctttcgagatttgcatcacatcgctgtgtagctgccctctgtaccggccattgtattacgtgtgtggcccaaggcgtaagggccgtgatgatttgacgtcatccccaccttcctctct

SEQ ID NO: 675 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales; Family: Flexibacteraceae
gaggtccgggaacgtattcaccgcgccattgctgatgcgcgattactagcgattccaacttcatgcaggcgagtgcagcctgcaatccgaactgagacgtacttttgtgattggctcgctatcgctagctggcaacactttgtatacgccattgtagcacgtgtgtagccctggacgtaagggccatgatgacctgacgtcatcccctccttcctctccg

SEQ ID NO: 676 - DNA, 220 bp, Unknown
  Description of Unknown: 16S RNA Operational Taxonomic Unit polynucleotide
  Phylum: Proteobacteria; Class: Betaproteobacteria; Order: Burkholderiales
aagacccgggaacgtattcaccgcgacatgctgatccgcgattactagcgattccgacttcacgcagtcgagttgcagactacgatccggacacgactggtttatgggattagctccccctcgcgggttggcaccctctgtaccagccattgtatgacgtgtgtagccctacccataagggccatgaggacttgacgtcatccccacttcctccggtttg

SEQ ID NO: 677 - DNA, 220 bp, Unknown
  Description of Unknown: 16S RNA Operational Taxonomic Unit polynucleotide
  Phylum: Proteobacteria; Class: Alphaproteobacteria; Order: Sphingomonadales
aaggcctgggaacgtattcaccgcggcatgctgatccgcgattactagcgattccgccttcatgctctcgagttgcagagaacaatccgaactgagacggttttgggagtttgtctcactctcgcgagtttgtctgcccacctgtcaccgccattgtagcacgtgtgtagcccagcgcgtaagggccatgaggacttgacgtcatccccaccttcctccg

SEQ ID NO: 678 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
acaaggtccgggaacgtattcaccgcgccattgctgatgcgcgattactagcgattccagcttcatgtagtcgagttgcagactacaatctgaactgagaagaggtttttgagatttgcatcctgtcaccaggtagcgtccctttgtcctccccattgtagcacgtgtgtagccctgggcataaaggccatgatgacctgacatcatcccctccttcctc

SEQ ID NO: 679 - DNA, 220 bp, Unknown
  Description of Unknown: 16S RNA Operational Taxonomic Unit polynucleotide
  Phylum: Proteobacteria; Class: Alphaproteobacteria; Order: Caulobacterales; Family: Caulobacteraceae
aaggcccgggaacgtattcgaccgcggcatgctgatccgcgattactagcgattccaacttcatgcactcgagttgcagagtgcaatccgaactgagacgactttttagggattggctccccctcgcgggattgcagccctctgtagtcgccattgtagcacgtgtgtagcccaccttgtaagggccatgaggacttgacgtcatccccacttcccccat

SEQ ID NO: 680 - DNA, 220 bp, Unknown
  Description of Unknown: 16S RNA Operational Taxonomic Unit polynucleotide
  Phylum: Cyanobacteria; Class: Nostocophycideae; Order: Nostocales; Family: Nostocaceae
aaggcccgggaacgaattcactgcagtatgctgacctgcaattactagcgattcctccttcacgcaggcgagttgcagcctgcgatctgaactgagctccggtttacgggatttgcttgcattcgcatgcttgctgccctctgtccggagcattgtagtacgtgtgtagcccaaggctaagggcatgctgacttgacgtcatcccacttcctccggtgtc

SEQ ID NO: 681 - DNA, 220 bp, Unknown
  Description of Unknown: 16S RNA Operational Taxonomic Unit polynucleotide
  Phylum: Proteobacteria; Class: Betaproteobacteria; Order: Rhodocyclales
aagacccgggaacgtattcaccgcgacatgctgatccgcgattactagcgattccgacttcatggagtcgagttgcagactccaatccggactacgacgcactttctgggattggctcccccttgcgggttggcaacctctgtatgcgccattgtatgacgtgtgaagccctacccataagggccatgaggacttgacgtcatccccaccttcctccggt

SEQ ID NO: 682 - DNA, 220 bp, Unknown
  Description of Unknown: 16S RNA Operational Taxonomic Unit polynucleotide
  Phylum: Actinobacteria; Class: Actinobacteria; Order: Actinomycetales
aaggcccgggaacgtattcgaccgcagcgttgctgatctgcgattactagcgactccgacttcatggggtcgagttgcagaccccaatccgaactgagaccggctttttagggatttcgctccacctcacggtttagcagccctctgtaccggccattgtagcatgtttgcagcccaagacataaggggcatgatgacttgacgtcatccccacttcctc

SEQ ID NO: 683 - DNA, 220 bp, Unknown
  Description of Unknown: 16S RNA Operational Taxonomic Unit polynucleotide
  Phylum: Cyanobacteria; Class: Synechococcophycideae; Order: Pseudanabaenales; Family: Pseudanabaenaceae
aagacccgggaacgtattcaccgcagtatgctgacctgcgattactagcgattccgccttcatgcaggcgagttgcagcctgcaatctgaactgtgcctcggttatgggatttgcttgtcatcgctgacttgctgcccttgtccgaagcattgtagtacgtgtgtagcccagaacgtaaggggcatgctgacttgacgtcatccccacttcctccgagtt

SEQ ID NO: 684 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtagcgttgctgatctacgattactagcgattccagcttcatgcaggcgagttgcagcctgcaatctgaactgagattaactttttgggattagctccttatcactaagtggcagtccctttgtagttaccattgtagcacgtgtgtacgccctgggcataaaggccatgatgacttgacatcatcccctccttcctc

SEQ ID NO: 685 - DNA, 220 bp, Unknown
  Description of Unknown: 16S RNA Operational Taxonomic Unit polynucleotide
  Phylum: Acidobacteria; Class: iii1-8; Order: 32-20
aaggccggaacgtattcgaccgcggcgtgctgatccgcgattactagcgattccagcttcatggggtcgagttgcagaccccaatccgaactgagaccggctttttgcgattgactccagcttgcgctttcgtagcgctttgtaccggccattgtagcacgtgtgtagccctggacataaaggccatgaggacttgacgtcatccccaccttcctccggt

SEQ ID NO: 686 - DNA, 220 bp, Unknown
  Description of Unknown: 16S RNA Operational Taxonomic Unit polynucleotide
  Phylum: Proteobacteria; Class: Betaproteobacteria; Order: Burkholderiales
aagacccgggaacgtattcaccgcggcaagctgatccgcgattactagcgattccgacttcacgcagtcgagttgcagactgcgatccggactacgaccgggtttctgggtattagctccccctcgcgggttggcagccctctgtccccggccattgtatgacgtgtgtagccctaccataagggccatgatgacctgacgtcatccccacttcctcccg

SEQ ID NO: 687 - DNA, 220 bp, Unknown
  Description of Unknown: 16S RNA Operational Taxonomic Unit polynucleotide
  Phylum: Acidobacteria; Class: Chloracidobacteria
aagaccccgggaacgtattcaccgcagcatgctgatctgcgattactagcgattccagcttcatggagtcgagttgcagactccaatccgaactgagacgagctttttccgattggctcccattgctggtttgcagcggtttgtactcgccattgtagcacgtgtgtagccctggacataaaggccatgaggacttgacgtcatccccaccttcctccgt

SEQ ID NO: 688 - DNA, 220 bp, Unknown
  Description of Unknown: 16S RNA Operational Taxonomic Unit polynucleotide
  Phylum: Proteobacteria; Class: Alphaproteobacteria; Order: Rhizobiales
gaggcccgggaacgtattcaccgtggcattctgatccacgattactagcgattccaacttcatgcactcgagttgcagagtgcaatccgaactgagacggcttttggagattagctcgacatcgctgcctcgctgcccattgtcaccgccattgtagcacgtgtgtagcccagcccgtaagggccatgaggacttgacgtcatccccaccttcctctcgg

SEQ ID NO: 689 - DNA, 220 bp, Unknown
  Description of Unknown: 16S RNA Operational Taxonomic Unit polynucleotide
  Phylum: Acidobacteria; Family: Koribacteraceae
aaggcccgggaacgtattcaccgcggcgtgctgatccgcgattactagcgattccagcttcatggagtcgagttgcagactccaatccgaactgaggccggcttttcattagctcccttcgcaggtttgcgacggtttgtaccgaccattgtagcacgtgtgtagccctggacataaaggccatgaggacttgacgtcatccccaccttcctccccgtat

SEQ ID NO: 690 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtagcattgctgatctacgattactagcgattccagcttcatgaagtcgagttgcagacttcaatctgaactgagaagcgttttttgggattagcttcacatcactgtgttgcagccctttgtacgctccattgtagcacgtgtgtagccctgggcataaaggccatgatgacttgacatcatcccctccttcctcag

SEQ ID NO: 691 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtctgggaacgtattcaccgtatcattgctgatatacgattactagcgattccagcttcacgcagtcgagttgcagactgcgatccgaactgagagacggtttttgggattggctccttatcgctaagtggcagccctttgtccgtcccattgtagcacgtgtgtagccctgggcataaaggccatgatgacctgacatcatcccctccttcctcgc

SEQ ID NO: 692 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatgaagtcgagttgcagacttcaatctgaactgagaggcgttttggattagcttcacatcactgtgttgcagccctttgtacgccccattgtagcacgtgtgtagccctgggcataaaggccatgatgacttgacatcatcccctctcctcacgtctt

SEQ ID NO: 693 - DNA, 220 bp, Unknown
  Description of Unknown: 16S RNA Operational Taxonomic Unit polynucleotide
  Phylum: Chloroflexi; Class: TK-SH13
aaggcccgggaacatattcaccgcgctatgctgacacgcggttactagcaactccgacttcatgcactcgggttgcagagtgcaatctgaactgaggccgcctttagagatctgctccccatcgctgggtggcttctcgctgtaacgaccattgtagcgtgtgtgtagccctggacgtaagagccatgctgacttgacatcatccccaccttcctccggt

SEQ ID NO: 694 - DNA, 220 bp, Unknown
  Description of Unknown: 16S RNA Operational Taxonomic Unit polynucleotide
  Phylum: Verrucomicrobia; Class: Opitutae; Order: Opitutales; Family: Opitutaceae
aaggcccgggaacgtattcacggcgtcgtagctgatacgccattactagcgattccaacttcatgtagtcgagttgcagactacaatctgaactgggcacggtttttggtttgcttcacctcgcggtgttgcgtccctctgtaccgtgcattgtagcacgtgtgcagccctggccgtaagggccatcctgacttgacgtcatcccaccttccaccctcag

SEQ ID NO: 695 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtagcattgctgatctacgattactagcgattccagcttcatgaggtcgagttgcagaccccaattcgaactgagacagattttttgtagattagcatcctgttaccaggtagcaaccctttgtatctgccattgtagcacgtgtgtagccctgggcgataaaggccatgatgacttgacatcatcccctccttccct

SEQ ID NO: 696 - DNA, 220 bp, Unknown
  Description of Unknown: 16S RNA Operational Taxonomic Unit polynucleotide
  Phylum: Nitrospirae; Class: Nitrospira; Order: Nitrospirales; Family: Nitrospiraceae
aaggcccgggaacgtattcaccgcggcgtgctgatccgcgattactagcgattccgccttcatggggtcgagttgcagaccccaatctgaactgaggccggttgtagattagcttccctttgcaggtttgcagctctctgtaccggtcattgtagcacgtgtgtagccccaggcataaaggccatgctgacttgacgtcatccccaccttcctccccgtt

SEQ ID NO: 697 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Bradyrhizobiaceae
aaggcccgggaacgtattcaccgtggcgtgctgatccacgattactagcgattccaacttcatgggctcgagttgcagagcccaatccgaactgagacggctttttgagatttgcgaagggtcgccccttagcatcccacttgtcaccgccattgtagcacgtgtgtagcccagcccgtaagggcctgagggacttgacgtcatccccaccttcctcgcg

SEQ ID NO: 698 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatgcagtcgagttgcagactgcaatctgaactgagagcgctttttggagttagtctccttgtcgccaagtggcagccctttcgttagcgcccattgtagcacgtgtgtagccctgggcataaaggccatgatgacttgacatcatcccctccttcctc

SEQ ID NO: 699 - DNA, 220 bp, Unknown
  Description of Unknown: 16S RNA Operational Taxonomic Unit polynucleotide
  Phylum: Proteobacteria; Class: Alphaproteobacteria; Order: Rhodospirillales; Family: Rhodospirillaceae
aaggcccgggaacgtattcaccgcggcgtgctgatccgcgattactagcgattccaacttcatgcacccgagttgcagagtgcaatccgaactgagacggcttttggggattagctccaggtcgccccttcgctcccactgtcaccgccattgtagcacgtgtgtagcccaacccgtaagggccatgaggacttgacgtcatccccgccttcctccggct

SEQ ID NO: 700 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatgaagtcgagttgcagacttcaatctgaactgagaggcgttttgggagttagcttcacatcgctgtgttgcagccctttgtacgcccacttgtagcacgtgtgtagccctgggcataaaggccatgatgacttgacatcatcccctccttcctcacg

SEQ ID NO: 701 - DNA, 220 bp, Unknown
  Description of Unknown: 16S RNA Operational Taxonomic Unit polynucleotide
  Phylum: Proteobacteria; Class: Alphaproteobacteria; Order: Rhodospirillales; Family: Rhodospirillaceae
aaggcccgggacgtattcaccgtggcgtgctgatccacgattactagcgattccgacttcatgcactcgagttgcagagtacaatccgaactgagacggcttttttgagattggcgcagggtcgccccttgcatcccactgtcaccgccattgtagcacgtgtgtagcccagcccgtaagggccatgaggacttgacgtcatccccgccttctccggctt

SEQ ID NO: 702 - DNA, 220 bp, Unknown
  Description of Unknown: 16S RNA Operational Taxonomic Unit polynucleotide
  Phylum: Cyanobacteria; Class: Nostocophycideae; Order: Nostocales; Family: Nostocaceae
aaggcccgggaacgaattcgactggcagtatgctgacctgcaattactagcgattcctccttcacgcaggcgagttgcagcctgcgatctgaactgagccacggtttatgagatttgcttgctatcgctagcttgctgccctttgtccgtagcattgtagtacgtgtgtagcccaagacgtaaggggcatgctgacttgacgtcatccccaccttcctcc

SEQ ID NO: 703 - DNA, 220 bp, Unknown
  Description of Unknown: 16S RNA Operational Taxonomic Unit polynucleotide
  Phylum: Acidobacteria; Class: Acidobacteria; Order: Acidobacteriales; Family: Acidobacteriaceae
aaggtccgggaacgtattcaccgcggcattctgatccgcgattactagcgattccagcttcacgcagtcgagttgcagactgcgatccgaactgaggccggctttttccgattagctccccctcgcgggtttgcgacggtttgtaccggccattgtagcacgtgtgtagccctggacataaaggccatgaggacttgacgtcatccccaccttcctcccc

SEQ ID NO: 704 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aaggcccgggaacgtatgaccgcgagcaatgctgatctgcgattactagcaactccgacttcatggggtcgagttgcagaccccaatccgaactgagacaggctttttgagattcgctcaacctcacggtatcgcagctctttgtacctgccattgtagcacgtgtgcagcccaagacataaggggcatgatgacttgacgtcgtccccaccttcctccg

SEQ ID NO: 705 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatgcagtcgagttgcagactgcaatctgaactgagagaaggttttgggattagctcttgtcgccaagtggcagccctttgtccttcccattgtagcacgtgtgtagccctgggcataaaggccatgatgacttgacatcatcccctccttcctcacgt

SEQ ID NO: 706 - DNA, 220 bp, Unknown
  Description of Unknown: 16S RNA Operational Taxonomic Unit polynucleotide
  Phylum: Cyanobacteria; Class: Nostocophycideae; Order: Nostocales; Family: Nostocaceae
aaggcccgggaacgaattcactgcagtatgctgacctgcaattactagcgattcctccttcacgcaggcgagttgcagcctgcgatctgaactgagctacgatttccgggatttgcttgctatcgctagcttgctgccctctgttcgtagcattgtagtacgtgtgtagcccaagacgtaaggggcatgctgacttgacgtcactcccctaccttccgct

SEQ ID NO: 707 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Brucellaceae
aaggcccgggaacgtattcaccgcggcatgctgatccgcgattactagcgattccaacttcatgcactcgagttgcagagtgcaatccgaactgagatggctttggagattagctcacactcgcgtgctcgctgcccactgtcacaccatttgtagcacggtgtgtagcccagcccgtaagggccatgaggacttgacgtcatccccacttcctctcggc

SEQ ID NO: 708 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Hyphomicrobiaceae
aaggcctgggaacgtattcaccgcagcgtgctgatccgcgattactagcaattccaacttcatgcactcgagttgcagagtgcaatccgaactgagatggcttttagggattagcatgacctcgcggtctagctgccctctgtcaccaccattgtagcacgtgtgtagcccagcccgtaagggccatgaagacttgacgtcatccccaccttcctccggc

SEQ ID NO: 709 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales; Family: Sphingobacteriaceae
aaggcccgggaacgtattcaccgcgtcattgctgatacgcgattactagcgaatccaacttcatggggtcgagttgcagaccccaatccgaactgtgaatggctttgtgagattcgcataccgttgccggctagctgcctctgtaccatccattgtagcacgtgtgtagcccggacgtaagggccatgatgacttgacgtcgtcccctcttcctctctgt

SEQ ID NO: 710 - DNA, 220 bp, Unknown
  Description of Unknown: 16S RNA Operational Taxonomic Unit polynucleotide
  Phylum: Acidobacteria; Class: Chloracidobacteria
aaggcccgggaacgtattcaccgcggcatgctgatctgcgattactagcgattccagcttcatggagtcgagttgcagactccaatccgaactgagacaagctttttgcgattggctccctttgcaggtttgcagcgctttgtacttgccattgtagcacgtgtgtagccctggacataaaggccatgaggacttgacgtcatccccaccttcctccgtt

SEQ ID NO: 711 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales; Family: Sphingobacteriaceae
gaggcccgggaacgtattcaccgcagcattgctgatctgcgattactagcgaatccaacttcacggggtcgagttgcagaccccgatccgaactgtgaacagctttttgagattggcatcctgttgccaggtagctgcctctgtactgcccattgtagcacgtgtgtagccccggacgtaagggccatgatgacttgacgtcgtccccctccttcctctc

SEQ ID NO: 712 - DNA, 220 bp, Unknown
  Description of Unknown: 16S RNA Operational Taxonomic Unit polynucleotide
  Phylum: Verrucomicrobia; Class: Verrucomicrobiae; Order: Verrucomicrobiales; Family: Verrucomicrobia subdivision 3
aaggcctgggaacgtattcacggcgccgtagctgatgcgccattactagcgattccaacttcatgccgtcgagttgcagacgacaatccgaactggggcccggttttttgggatttgtctccacctgacggtcttgcttccctctgtgccgggcattgtagtacgtgtgcagccctggccgtaagggccatactgacttgacgtcatccccaccttcctc

SEQ ID NO: 713 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aagacccgggaacgtattcaccgtatcattgctgatatacgattactagcgattccagcttcacgcagtcgagttgcagactgcgatctgaactgagagagggtttttgagattggctccttatcgctaagtggcagctctttgtccctcccattgtagcacgtgtgtagccctgggcataaaggccatgatgacttgacatcatcccctccttcctcgc

SEQ ID NO: 714 - DNA, 220 bp, Unknown
  Description of Unknown: 16S RNA Operational Taxonomic Unit polynucleotide
  Phylum: Firmicutes; Class: Bacilli; Order: Bacillales; Family: Paenibacillaceae
aagacccgggaacgtattcaccgcggcatgctgatccgcgattactagcaattccgacttcatgcaggcgagttgcagcctgcaatccgaactgagaccggctttttaggattcgttccacctcgcggtttcactgccccgttgtaccggccattgtagtacgtgtgtagcccagggtcataagggggcatgatgatttgacgtcatccccaccttcctc

SEQ ID NO: 715 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aagggcccggggaacgtattcaccgcagcaatgctgatctgcgattactagcaactccgacttcatggggtcgagttgcagaccccaatccgaactgagaccggcttttttgagattcgctccacctcacggtttcgcagctctttgtaccggccattgtagcacgtgtgcagcccaagacataaggggcatgatgacttgacgtcgtccccaccttcct

SEQ ID NO: 716 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Actinosynnemataceae
aaggcccgggaacgtattcaccgcagcgttgctgatctgcgattactagcgactccgacttcacggggtcgagttgcagaccccgatccgaactgagaccggctttatgggattcgctccacctcacggcttagcagccctttgttaccggcccattgtagcatgtgtgaagccctggacataaggggcgatgatgacttgacgtcatcccaccttcctc

SEQ ID NO: 717 - DNA, 220 bp, Unknown
  Description of Unknown: 16S RNA Operational Taxonomic Unit polynucleotide
  Phylum: Cyanobacteria; Class: Nostocophycideae; Order: Nostocales; Family: Nostocaceae
aaggccggaacgaatcggactgcagtatgctgacctgcaattactagcgattcctccttcacgcaggcgagttgcagcctgcgatctgaactgagctccggtttacgggatttgcttgccatcgctggcttgctgccctctgtccggagcattgtagtacgtgtgtagcccaaggcgtaaggggcatgctgacttgacgtcatccccaccttcctccggt

SEQ ID NO: 718 - DNA, 220 bp, Unknown
  Description of Unknown: 16S RNA Operational Taxonomic Unit polynucleotide
  Phylum: Chlamydiae; Class: Chlamydiae; Order: Chlamydiales; Family: Rhabdochlamydiaceae
aaggcccgggaacgtattcacgacgttgttgctgacacgtcattactagcaattccaacttcatgtagtcgagttgcagactacaatccgaactgggatcggctttacggatttgctccaccttgcggtcttgctgccttctgtaccgaccattgtagcacgtgtgtagccccagatataaaggccatgcggacttgacgtcatcctcaccttctcctgt

SEQ ID NO: 719 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales; Family: Sphingobacteriaceae
aaggcccgggaacgtattcaccgcagcattgctgatctgcgattactagcgaatccaacttcacggggtcgagttgcagaccccgatccgaactgtgaatggcttttggagattggcatcctgttaccaggtagctgccctctgtaccatccattgtagcacgtgtgtagccccggacgtaagggccatgatgacttgacgtcgtcccctccttcctccg

SEQ ID NO: 720 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Comamonadaceae
aagacccgggaacgtattcaccgtgacattctgatccacgattactagcgattccgacttcacgcagtcgagttgcagactgcgatccggactacgactggttttatgggattagctccccctcgcgggttggcaaccctttgtaccagcccattgtatgacgtgtgtagcccccaacctataaggggccatgagacttgacgtcatccccaccttcctc

SEQ ID NO: 721 - DNA, 220 bp, Unknown
  Description of Unknown: 16S RNA Operational Taxonomic Unit polynucleotide
  Phylum: Proteobacteria; Class: Alphaproteobacteria; Order: Rhizobiales
aaggcccgggaacgtattcaccgcagcgtgctgatctgcgattactagcgattccaacttcatggggtcgagttgcagaccccaatccgaactgagacggctttttgagatttgtcgaagggtcggccccctttcgcatccctctgtcaccgccattgtagcacgtgtgtagcccagcccgtaagggccatgaggacttgacgtcatcccccaccttcct

SEQ ID NO: 722 - DNA, 220 bp, Unknown
  Description of Unknown: 16S RNA Operational Taxonomic Unit polynucleotide
  Phylum: Proteobacteria; Class: Deltaproteobacteria; Order: Myxococcales; Family: Polyangiaceae
aaggcccgggaacgtattcacccctgcctgctgatcagggattactagcgattccaacttcaaagagtcgagttgcagactcttatccgtactgaggccggttttttcggattggctcccccctcgcgggttagcgaccgtctgtaccgaccattgtagcacgtgtgtagccctggacataagggccatgaggacttgacgtcatccccaccttcctccg

SEQ ID NO: 723 - DNA, 220 bp, Unknown
  Description of Unknown: 16S RNA Operational Taxonomic Unit polynucleotide
  Phylum: Firmicutes; Class: Bacilli; Order: Bacillales; Family: Bacillaceae
aaggcccgggaacgtattcaccgcggcatgctgatccgcgattactagcgattccagcttcacgcagtcgagttgcagactgcgatccgaactgagaacagatttatgggattggctaaaccttgcggtcttgcagcccctttgttctgtccattgtagcacgtgtggtagcccaggtcataaggggcatgatgatttgacgtcatccccaccttcctcc

SEQ ID NO: 724 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aagggtcccgggaacgtattcaccgtatcattgctgatatacgattactagcgattccagcttcacgcagtcgagttgcagactgcgatctgaactgagagaaggttttgagattagctccctgtcaccaggtggcagccctttgtccttcccattgtagcacgtgtgtagccctgggcataaaggccatgatgacttgacatcatcccctccttcctcg

SEQ ID NO: 725 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales; Family: Flexibacteraceae
aaggtccgggaacgtattcaccgcgccattgctgatgcgcgattactagcgattccaacttcatgcaggcgagttgcagcctgcaatccgaactgagacgtcctttttgtgattggcttcctgtcaccaggtcgcaacactttgtagacgccattgtagcacgtgtgtagccctgggcgtaagggccatgatgacctgacgtcatcccctccttcctctg

SEQ ID NO: 726 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Streptomycetaceae
aagggcccgggaacgtattcaccgcagcaatgctgatctgcgattactagcaactccgacttcatggggtcgagttgcagaccccaatccgaactgagacaggctttttgagattcgctccacctcacggtatcgcagctcattgtacctgccattgtagcacgtgtggcagcccaagacataaggggcatgactgaccttgacgtcgtccccaccttcc

SEQ ID NO: 727 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales; Family: Flexibacteraceae
aaggtccggacgtattcaccgcgccattgctgatgcgcgattactagcgattccagcttcatgaggtcgagttgcagacctcaatccgaactgagacgccctttgtgattggcttactattactagctcgcaacactctgtaggcgccattgtagcacgtgtgtagccctggacgtaagggccatgatgacctgacgtcatcccctccttcctctctgct

SEQ ID NO: 728 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales; Family: Sphingobacteriaceae
aagacccgggaacgtattcaccgcgtcatgctgatacgcgattactagcgaatccaacttcaagaggtcgagttgcagacctctatccgaactgtgaatggctttttgagattcgcttgctgttaccagctcgctgccctctgtaccatccattgtagcacgtgtgtagccccggacgtaagggccatgatgacttgacgtcgtcccctccttcctctct

SEQ ID NO: 729 - DNA, 220 bp, Unknown
  Description of Unknown: 16S RNA Operational Taxonomic Unit polynucleotide
  Phylum: Proteobacteria; Class: Deltaproteobacteria; Order: Myxococcales
aaggcccgggaacgtattcaccgctgccatgctgatcagcgattactagcgattccgacttcaaggagtcgagttgcagactcctatctgtactgaggttgactttttgagattggctccccctcgcgggttcgcgaccctttgtatcaaccattgtagcacgtttgtagccctggacataagggccatgatgacttgacgtcatccccacttcctccac

SEQ ID NO: 730 - DNA, 220 bp, Unknown
  Description of Unknown: 16S RNA Operational Taxonomic Unit polynucleotide
  Phylum: Firmicutes; Class: Bacilli; Order: Bacillales; Family: Alicyclobacillaceae
aaggcccggaacgaattcaccgcggcatgctgatccgcgattactagcaattccggcttcatgcaggcgagttgcagcctgcaatccgaactacgaacggcttatgagattggctccacctcgcggtctcgcgtctcttgtaccgcccattgtagcacgtgtgtagcccaagacataaggggcatgatgatttgacgtcatccccgcttcctccggttgt

SEQ ID NO: 731 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatggagtcgagttgcagactccaatctgaactgagtaggcgttttggattagccttcatatcgctatgttgcagccctttgtacgccccattgtagcacgtgtgtagccctgggcataaaggccatgatgacttgacatcatcccctccttcctcacg

SEQ ID NO: 732 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Kineosporiaceae
aaggcccgggacgtattcgaccgcagcgttgctgatctgcgattactagcgactccgacttcacggggtcgagttgcagaccccgatccgaactgagaccagctttttgggattcgctccaccttacggtctcgcagccctttgtactggccattgtagcatgcgtgaagcccaagacataaggggcatgatgatttgacgtcgtccccaccttcctccg

SEQ ID NO: 733 - DNA, 220 bp, Unknown
  Description of Unknown: 16S RNA Operational Taxonomic Unit polynucleotide
  Phylum: Chlorobi; Class: SM1B09
aaggcccgggaacgtattcaccgcagcgtgctgatctgcgattactagcgattccagcttcatgcagtcgagttgcagactgcaatctgtactgaggacggttttgggttttctccacctcgcggcttcgcccattgtaccgtccattgtagcacgtgtgtagccctagacgtaaggaccatgatgacttgacgtcatccccacttcctcactacttgcg

SEQ ID NO: 734 - DNA, 220 bp, Unknown
  Description of Unknown: 16S RNA Operational Taxonomic Unit polynucleotide
  Phylum: Proteobacteria; Class: Gammaproteobacteria; Order: Legionellales; Family: Coxiellaceae
acaaggcccgggaacgtattcaccgcgacaatgctgattcgcgattactagcgattccaacttcatggagtcgagttgcagactccaatccggactacgagacgctttaagagattggctccccctcgcgggttggctaccctctgtacgacccattgtagcacgtgtgtagccctacccataaaggccatgatgacttgacgtcgtccccgccttcctc

SEQ ID NO: 735 - DNA, 220 bp, Unknown
  Description of Unknown: 16S RNA Operational Taxonomic Unit polynucleotide
  Phylum: Acidobacteria; Class: Acidobacteria; Order: Acidobacteriales
aaggcccgggaacgtattcaccgcggcatgctgatccgcgattactagcgattccaacttcacgcaggcgagttgcagcctacgatccgaactgagaccggcttttctccgattagcctccccctcgcgggatcgcaacggtttgtaccggccattgtagcacgtgtgtagccctggacataaaggccatgctgacttgacgtcatccccaccttcctcc

SEQ ID NO: 736 - DNA, 220 bp, Unknown
  Description of Unknown: 16S RNA Operational Taxonomic Unit polynucleotide
  Phylum: Acidobacteria; Class: Chloracidobacteria
aagacccgggaacgtattcaccgcagcatgctgatctgcgattactagcgattccagcttcatggagtcgagttgcagactccaatccgaactgagacaagctttttgcgattggctcccccttgcaggtttggtcagcgctttgttacttgccattgtagcacgtgtgtagccctcggacataaaggccatgaggacttgacgtcatccccacccttcc

SEQ ID NO: 737 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales; Family: Flexibacteraceae
aaggtccgggaacgtattcaccgcgccattgctgatgcgcgattactagcgattccaacttcatgcaggcgagttgcagcctgcaatccgaactgagacgtactttttgtgattggctcaccattgctggcttgcaacactttgtatacgccattgtagcacgtgtgtagccctgggctaagggccatgatgacttgacgtcatcccctcttcctctctg

SEQ ID NO: 738 - DNA, 220 bp, Unknown
  Description of Unknown: 16S RNA Operational Taxonomic Unit polynucleotide
  Phylum: Proteobacteria; Class: Gammaproteobacteria; Order: Legionellales; Family: Coxiellaceae
aaggcccgggaacgtattcaccgcgacaaatgctgattcgcgattactagcgattccgacttcatggagtcgagttgcagactccaatctggactacgagacgctttaagagattagctccccctcgcggttggcaaccctctgtacgccccattgtagcacgtgtgtagccctacccataaaggccatgatgacttgacgtcgtccccgccttcctccg

SEQ ID NO: 739 - DNA, 220 bp, Unknown
  Description of Unknown: 16S RNA Operational Taxonomic Unit polynucleotide
  Phylum: Proteobacteria; Class: Alphaproteobacteria; Order: Rhizobiales; Family: Rhizobiaceae
aaggcccgggaacgtattcaccgcggcatgctgatccgcgattactagcgattccaacttcatgcactcgagttgcagagtgcaatccgaactgagatggctttttggagattagctcgacatcgctgtctcgctgcccactgtcaccaccattgtagcacgtgtgtagccccagccccgtaagggccatgaggacttgacgtcatcccccacttcctct

SEQ ID NO: 740 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Micromonosporaceae
aaggcccgggaacgtaattcgaccgcagcgttgctgatctgcgattactagcgactccgacttcacgggggtcgagttgcagaccccgatccgaactgagaccggctttttgggattcgctccacctcacggcatcgcaaccctttgtaccggccattgtagcatgcgtgaagccctggacataagggggcatgatgacttgacgtcatccccaccttcc

SEQ ID NO: 741 - DNA, 220 bp, Unknown
  Description of Unknown: 16S RNA Operational Taxonomic Unit polynucleotide
  Phylum: Proteobacteria; Class: Gammaproteobacteria; Order: Pseudomonadales; Family: Pseudomonadaceae
aaggcccgggaacgtattcaccgcgacattctgattcgcgattactagcgattccgacttcacgcagtcgagttgcagactgcgatccggactacgatcggttttgtgggattagctccacctcgcggcttggcaaccctctgtaccgaccattgtagcacgtgtgtagcccaggccgtaagggcccatgatgcttgacgtcatcccccaccttcctccg

SEQ ID NO: 742 - DNA, 220 bp, Unknown
  Description of Unknown: 16S RNA Operational Taxonomic Unit polynucleotide
  Phylum: Gemmatimonadetes; Class: Gemmatimonadetes; Order: Gemmatimonadales
aaggcccgggaacgtattcaccgcggcgtggctgatccgcgattactagcgattccagcttcatgtgggcgagttgcagcccacaatccgaacttagaccggcttttagcgattagcgtactcttgcgagttagcgacgccctgtaccggccattgtagcacgtgtgtcgccctggacgtaagggccatgatgacttgacgtcgtcccccttcctccggt

SEQ ID NO: 743 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales; Family: Flexibacteraceae
aaggcccgggaacgtattcaccgcgtcatagctgatacgcgattactagcgattccagcttcatagagtcgagttgcagactccaatccgaactgagaacggctttttgggattggcatctcatcactgagtagcgaccctctgtaccgcccattgtagcacgtgtgttgccctggactaagggccatgatgacttgacgtcgtccctcttcctctctgt

SEQ ID NO: 744 - DNA, 220 bp, Unknown
  Description of Unknown: 16S RNA Operational Taxonomic Unit polynucleotide
  Phylum: Proteobacteria; Class: Gammaproteobacteria; Order: Pseudomonadales; Family: Pseudomonadaceae
aagacccgggaacgtattcaccgcgacattctgattcgcgattactagcgattccgacttcacgcagtcgagttgcagactgcgatccggactacgatcggttttatgggatagctccacctcgcggcttggcaaccctttgtaccgaccattgtagcacgtgtgtagcccaggccgtaagggccatgatgacttgacgtcatccccaccttcctccggt

SEQ ID NO: 745 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales; Family: Flexibacteraceae
aaggtccgggaacgtattcaccgcagcattgctgatctgcgattactagcgattccaacttcatgcaggcgagttgcagcctgcaatccgaactgagacgtccttttgtgattggctcgctatcactagctggcaacactttgtagacgccattgtagcacgtgtgtagccctgggcgtaagggccatgatgacttgacgtcatccctccttcctctctg

SEQ ID NO: 746 - DNA, 220 bp, Unknown
  Description of Unknown: 16S RNA Operational Taxonomic Unit polynucleotide
  Phylum: Verrucomicrobia; Class: Verrucomicrobiae; Order: Verrucomicrobiales
aaggcctgggaacgtattcacggcgccgtagctgatgcgccattactagcgattccaacttcatgtcgtcgagttgcagacgacaatctgaactgagcccggtttctgagatttgctccacctgtcggtcttgcttccctttgtaccgggcattgtagtacgtgtgcagccctggccgtaagggccatactgacttgacgtcatccccaccttcctcctc

SEQ ID NO: 747 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatggagtcgagttgcagactccaatctgaactgagagacgttttgagattggcttcacatcgctgtgttgctgctctttgtacgtcccattgtagcacgtgtgtagccctgggcataaaggccatgactgaccttgacatcatcccctccttcctcaa

SEQ ID NO: 748 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Thermomonosporaceae
aagggcccggaacgtattcggaccgcgagcgttgctgatctgcgattactagcgactccgacttcatggggtcgagttgcagaccccaatccgaactgagaccggctttaagggattcgctccaccttgccggtatcgcagccctctgtaccggccattgtagcatgtttgcagcccaagacataaggggcatgatgacttgacgtcatccccaccttcc

SEQ ID NO: 749 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Micromonosporaceae
aaggcccgggaacgtattcaccgcagcgttgctgatctgcgattactagcgactccgacttcacggggtcgagttgcagaccccgatccgaactgagaccggcttttttgggattcgctccacctcacggcatcgcaaccctttgtaccggccattgtagcatgcgtgaagccctggacataaggggcatgatgacttgacgtcatcccactcccgagtt

SEQ ID NO: 750 - DNA, 220 bp, Unknown
  Description of Unknown: 16S RNA Operational Taxonomic Unit polynucleotide
  Phylum: Proteobacteria; Class: Gammaproteobacteria; Order: Xanthomonadales; Family: Xanthomonadaceae
agggcccgggaacgtattcaccgcagcaatgctgatctgcgattactagcgattccgacttcatggagtcgagttgcagactccaatccggactgagatggggtttctgggattggctcaccgtcgccggcttgcagccctctgtccccaccattgtagtacgtgtgtagccctggcgtaagggccatgatgacttgacgtcatccccaccttcctccgg

SEQ ID NO: 751 - DNA, 220 bp, Unknown
  Description of Unknown: 16S RNA Operational Taxonomic Unit polynucleotide
aaaactaaagtacatttcaccgtaacatgatgatttacgattactagcaattcctccttcataccttcgaattacagaagataatctgaacttcggaatttttatagatttacacaggttttgccttgttactttttataaattcccttgtagcagatctattgcccaaaccatgagggccatattgacttagcataatcctcaccttcctcaatttact

SEQ ID NO: 752 - DNA, 220 bp, Unknown
  Description of Unknown: 16S RNA Operational Taxonomic Unit polynucleotide
  Phylum: Verrucomicrobia; Class: Verrucomicrobiae; Order: Verrucomicrobiales; Family: Verrucomicrobiaceae
aagacccgggaacgtattcacgcggccgtagctgatgccgcattactagcgattccggcttcatggaggcgagttgcagcctccaatccgaactgagcccagttttacagatttcctccacctcgcggtctcggttctcattgtgctgggcattgtagtacgtgtgcagccctaggcgtaagggccatactgacctgacgtcgtcccacttcctccccgt

SEQ ID NO: 753 - DNA, 220 bp, Unknown
  Description of Unknown: 16S RNA Operational Taxonomic Unit polynucleotide
  Phylum: Proteobacteria; Class: Alphaproteobacteria; Order: Caulobacterales; Family: Caulobacteraceae
aaggcccgggaacgtattcaccgcggcatgctgatccgcgattactagcgattccgacttcatgctctcgagttgcagagaacaatccgaactgagacgactttttgggattggctcaccatcgctggttgcagcctctgtagtcgccattgtagcacgtgtgtagcccaccttgtaagggccatgaggacttgacgtcatccccgccttcctccggaat

SEQ ID NO: 754 - DNA, 220 bp, Unknown
  Description of Unknown: 16S RNA Operational Taxonomic Unit polynucleotide
  Phylum: Proteobacteria; Class: Deltaproteobacteria; Order: Myxococcales
aaggccgggacgtattcaccgctgcctgctgatcagcgattactagcgattccgacttcatgtactcgagttgcagagtacaatctgtactgaggtgcacttttgcgattggcttactctcgcgagcttgctgcgctctgtatgcaccattgtagcacgtgtgtagccctggacataagggccatgaggacttgacgtcgtccccaccttcctccggctt

SEQ ID NO: 755 - DNA, 220 bp, Unknown
  Description of Unknown: 16S RNA Operational Taxonomic Unit polynucleotide
  Phylum: Proteobacteria; Class: Gammaproteobacteria; Order: Xanthomonadales; Family: Xanthomonadaceae
aaggcccgggaacgtattcaccgcagcatagctgatctgcgattactagcgattccgacttcacgaagtcgagttgcagacttcgatccggactgggatcggcttctgggatttggctccacctcgcggtattgcaaccctctgtaccgaccattgtagtacgtgtgtagccctggccgtaagggccatgatgacttgacgtcatccccaccttcctccg

SEQ ID NO: 756 - DNA, 220 bp, Unknown
  Description of Unknown: 16S RNA Operational Taxonomic Unit polynucleotide
  Phylum: Proteobacteria; Class: Alphaproteobacteria; Order: Caulobacterales; Family: Caulobacteraceae
aaggcccgggaacgtattcaccgcggcatgctgatccgcgattactagcgattccaacttcatgcactcgagttgcagagtgcaatccgaactgagacgacttttagggattggctcccccgcgggattgcagccctctgtagtcgccattgtagcacgtgtgtagcccaccttgtaaggccatgaggacttgacgtcatccccacttcctccggcttac

SEQ ID NO: 757 - DNA, 220 bp, Unknown
  Description of Unknown: 16S RNA Operational Taxonomic Unit polynucleotide
  Phylum: Actinobacteria; Class: Actinobacteria; Order: Actinomycetales
aaggcccgggaacgtattcgaccgacgagcgttgctgatctgcgattactagcgactccgacttcatggggtcgagttgcagaccccaatccgaactgagaccggcttttaagggattcgctccaccttgcggtatcgcagccctctgtaccggccattgagcatgtttgcagcccaagacataaggggcatgatgacttgacgtcatccccacttcctc

SEQ ID NO: 758 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Burkholderiaceae
aagacccgggaacgtattcaccgcggcatgctgatccgcgattactagcgattccagcttcacgtagtcgagttgcagactacgatccggactacgatgcatttttctgggattggctccacctcgcggctttggcaacccctctgtatgcaccattgtatgacgtgtgaagccctacccataagggccatgaggacttgactcatcccccaccttcctc

SEQ ID NO: 759 - DNA, 220 bp, Unknown
  Description of Unknown: 16S RNA Operational Taxonomic Unit polynucleotide
  Phylum: Proteobacteria; Class: Gammaproteobacteria; Order: Xanthomonadales; Family: Xanthomonadaceae
aaggcccgggacgtattcaccgcagcaatgctgatctgcgattactagcgattccgacttcacggagtcgagttgcagactccgatccggactgagatcaggtttctgggattggctcaccctcgcgggattgcagccctctgtcctgaccattgtagtacgtgtgtagccctggccgtaagggccatgatgacttgacgtcatccccaccttcctccgg

SEQ ID NO: 760 - DNA, 220 bp, Unknown
  Description of Unknown: 16S RNA Operational Taxonomic Unit polynucleotide
  Phylum: Proteobacteria; Class: Alphaproteobacteria
aaggcccgggaacgtattcaccgcagcctgctgttctgcgattactagcgattccaccttcatgcactcgagttgcagagtgcaatctgaactgggacggttttagagattagcatgctctcgcgagctagctgctcactgtcaccgccattgtagcacgtgtgtagcccagggtgtaagggccatgaggacttgacgtcatccccactcctccggcttg

SEQ ID NO: 761 - DNA, 220 bp, Unknown
  Description of Unknown: 16S RNA Operational Taxonomic Unit polynucleotide
  Phylum: Proteobacteria; Class: Gammaproteobacteria; Order: Legionellales; Family: Coxiellaceae
aaggcccgggaacgtattcaccgcgacattctgattcgcgattactagcgattccgacttcatggagtgagttgcagactccaatccggactacgatcggctttctgggattggctccccctcgcgggttggctccctctgtaccgaccattgtagcacgtgtgtagccctacccataaaggccatgatgacttgacgtcgtccccgccttcctccggtt

SEQ ID NO: 762 - DNA, 220 bp, Unknown
  Description of Unknown: 16S RNA Operational Taxonomic Unit polynucleotide
  Phylum: Cyanobacteria; Class: Oscillatoriophycideae; Order: Oscillatoriales; Family: Phormidiaceae
aaggcccgggaacggattcaccgcagtatgctgacctgcgattactagcgattccgccttcatgggcgagttgcagcactgcaatctgaactgaggcagggtttacgggattagctcgccctcgcgggttggctgccccctctgtcccctaccattgtagtacgtgtgtagcccagggacgtaaggggcatgctgacttgacgtcatccccaccttcctc

SEQ ID NO: 763 - DNA, 220 bp, Unknown
  Description of Unknown: 16S RNA Operational Taxonomic Unit polynucleotide
  Phylum: Actinobacteria; Class: Actinobacteria; Order: Actinomycetales; Family: Dietziaceae
aagacccgggaacgtattcaccgcagcgttgctgatctgcgattactagcgactccaacttcatggggtcgagttgcagaccccaatccgaactgagaccagctttaagagattcgctccacctcacggtatcgcagccctctgtactagccattgtagcatgtgtgaagccctagacataaggggcatgatgatttgacgtcatccccaccttcctccg

SEQ ID NO: 764 - DNA, 220 bp, Unknown
  Description of Unknown: 16S RNA Operational Taxonomic Unit polynucleotide
  Phylum: Proteobacteria; Class: Alphaproteobacteria; Order: Sphingomonadales
aaggcctgggaacgtattcaccgcggcatgctgatccgcgattactagcgattccgccttcatgccctcgagttgcagaggacaatccgaactgagacggctttggagattagctcacccttgcgggtcgctgcccactgtcaccgccattgtagcacgtgtgtagcccagcctgtaagggccatgaggacttgacgtcatccccaccttccccccgtac

SEQ ID NO: 765 - DNA, 220 bp, Unknown
  Description of Unknown: 16S RNA Operational Taxonomic Unit polynucleotide
aaggcccgggaacgtattcaccgcagcatgtctgatctgcgattactagcgattccgacttcatggagtcgagttgcagactccaatccgaactgagatcggcttttgagattagcttcacatcactgtgttgcaaccctttgtaccgaccattgtagtacgtgtgtagcccaaggtataaaggccatgatgacttgacgtcgtccctccttcctcactg

SEQ ID NO: 766 - DNA, 220 bp, Unknown
  Description of Unknown: 16S RNA Operational Taxonomic Unit polynucleotide
  Phylum: Proteobacteria; Class: Betaproteobacteria
aagacccgggaacgtattcaccgcggcatgctgatccgcgattactagcgattccgacttcatgctctcgagttgcagagaacaatccggactacgaccggctttcctgggattgctccccctcgcgggttggcagccctctgtaccggccattgtattacgtgtgaagccctacccataagggccatgaggacttgacgtcatccccaccttcctccgg

SEQ ID NO: 767 - DNA, 220 bp, Unknown
  Description of Unknown: 16S RNA Operational Taxonomic Unit polynucleotide
  Phylum: Cyanobacteria; Class: Oscillatoriophycideae; Order: Oscillatoriales; Family: Phormidiaceae
aaggcccgggaacggattcaccgcagtatgctgacctgcgattactagcgattccgccttcatgcaggcgagttgcagcctgcaatctgaactgaggcagggtttacgggattagctcgccctcgcgggttggctgcccctctgtcctaccattgtagtacgtgtgtagcccggacgtaaggggcatgctgacttgacgtcatcccaccttcctccgggt

SEQ ID NO: 768 - DNA, 220 bp, Unknown
  Description of Unknown: 16S RNA Operational Taxonomic Unit polynucleotide
  Phylum: Proteobacteria; Class: Betaproteobacteria; Order: Burkholderiales
aagacccgggaacgtattcaccgcggcaagctgatccgcgattactagcgattccgacttcacgcagtcgagttgcagactgcgatccggactacgaccggttttctgggattggctccacctcgcggcttggctacccctctgttccgaccattgtatgacgtgtgaagccctacccataaggggccatgaggacttgacgtcatccccaccttcctcc

SEQ ID NO: 769 - DNA, 220 bp, Unknown
  Description of Unknown: 16S RNA Operational Taxonomic Unit polynucleotide
  Phylum: Bacteroidetes; Class: Sphingobacteria; Order: Sphingobacteriales
aaggtccgggaacgtattcaccgtatcattgctgatatacgattactagcgattccagcttcatgaggtcgagttgcagacctcaatccgaactgagatagagtttttgagattagcagcatgttaccatgtagcagccctttcgttctctaccattgtagcacgtgtgtagccctcgggcataaaggccatgatgacttgacatcatcccctccttcct

SEQ ID NO: 770 - DNA, 220 bp, Unknown
  Description of Unknown: 16S RNA Operational Taxonomic Unit polynucleotide
  Phylum: Planctomycetes; Class: Phycisphaerae
aaggctcaggaacacattcaccgcggcgtagctgatccgcgattactagcgattccaacttcacggaggcgagttgcagcctccgatctgaactggggggtgatttgtgcgatttcctccagcttgcgctctcggttcgctttgtgcaccccattgtagcacgtgtgtggccctggcataaaggccatgaggacttgacgtcatctccaccttcctccgg

SEQ ID NO: 771 - DNA, 220 bp, Unknown
  Description of Unknown: 16S RNA Operational Taxonomic Unit polynucleotide
  Phylum: Proteobacteria; Class: Alphaproteobacteria; Order: Caulobacterales; Family: Caulobacteraceae
aaggcctgggaacgtattcaccgcggcatgctgatccgcgattactagcgattccgacttcatgctctcgagttgcagagaacaatccgaactgagacgacttttgggattggctccccatcgctggtttgctgccctctgtagtcgccattgtagcacgtgtgtagcccaccctgtaagggccatgaggacttgacgtcatccccacttcctccggctt

SEQ ID NO: 772 - DNA, 220 bp, Unknown
  Description of Unknown: 16S RNA Operational Taxonomic Unit polynucleotide
  Phylum: TM7; Class: TM7-1
aaggcccgggaacgtattcacggtaataatagctgactcaccgttactagcgattccgacttcaagcaggcgagtttcagcctgctatccgaactgggaccggctttgatgggatttgctccccctcgcgggttggctgccctttgtaccggccattgtagcgtgtttgtagcccaaggcataagggaaatactgacctgacatcatccctccttcctcc

SEQ ID NO: 773 - DNA, 220 bp, Unknown
  Description of Unknown: 16S RNA Operational Taxonomic Unit polynucleotide
  Phylum: Proteobacteria; Class: Alphaproteobacteria; Order: Sphingomonadales
aaggcctgggaacgtattcaccgcggcatgctgatccgcgattactagcgattccgccttcatgctctcgagttgcagagaacaatccgaactgagaccggtttttggggatttgctcactctcgcgagtttgctgcccactgtcaccgccattgtagcaccgtgtgtagcccagcgcgtaagggcccatgaggacttgacgtcatccccacttcctccg

SEQ ID NO: 774 - DNA, 220 bp, Unknown
  Description of Unknown: 16S RNA Operational Taxonomic Unit polynucleotide
  Phylum: TM7; Class: TM7-3; Order: EW055
aagacccgggaacgtattcaccgcaatttgctgacttgcgattactagcgattccgacttcatggaggcgagtttcagcctccaatccgaactgggaccggctttgatgcgatttgcttcacctcgcggcttcgcagcgcattgtaccggccattgtatcacgtttctagcccaggacgtaagagaaatactgacctgacgtcatcccctcttcctcccg

SEQ ID NO: 775 - DNA, 220 bp, Unknown
  Description of Unknown: 16S RNA Operational Taxonomic Unit polynucleotide
  Phylum: Proteobacteria; Class: Alphaproteobacteria; Order: Sphingomonadales
aaggcccgggaacgtattcaccgcggcatgctgatccgcgattactagcgattccgccttcatgctctcgagttgcagagaacaatccgaactgagacggcttttggagattagctagcccttgcgggattgctgctcactgtcaccgccattgtagcacgtgtgtagcccagcttgtaagggccatgaggacttgacgtcatccccaccttcctccggc

SEQ ID NO: 776 - DNA, 220 bp, Unknown
  Description of Unknown: 16S RNA Operational Taxonomic Unit polynucleotide
  Phylum: Proteobacteria; Class: Betaproteobacteria; Order: Burkholderiales; Family: Burkholderiaceae
aagacccgggaacgtattcaccgcggcatgctgatccgcgattactagcgattccaggcttcacacacccgagttgcagagtgcgatccggactacgaccggttttctgggattggctccacctcgcggcttggcgaccctctgttccgaccattgtatgacgtgtgaagccctaccataaggggccatgaggactcgacgtcactccccaccttcctcc

SEQ ID NO: 777 - DNA, 220 bp, Unknown
  Description of Unknown: 16S RNA Operational Taxonomic Unit polynucleotide
  Phylum: Gemmatimonadetes; Class: Gemmatimonadetes
aaggcccgggaacggattcaccgtggcgtagctgatccacgattactagcgattccaacttcatgcagtcgagttacagactgcaatccgaacttagaccgggtttttccgattcgctcactctcacgagctcgcagcggtttgtcccggccattgtagcacgtgtgtagccctggacgtaaggaccatgatgacttgacgtcgtcccccttcctccggt

SEQ ID NO: 778 - DNA, 220 bp, Unknown
  Description of Unknown: 16S RNA Operational Taxonomic Unit polynucleotide
aaagggcagggacgtagtcaacgcgagctgatgactcgcgcttactaggaattcctcgttgaagaccaacaattgcaatgatctatccccatcacgatgaaatttcaaagattacccgggcctgtcggccaaggtgtgaactcgttgaatacatcagtgtagcgcgcgtgcggcccagaacatctaagggcatcacagacctgtatgctcaacttcctgg

SEQ ID NO: 779 - DNA, 1424 bp, Enterobacter rodasii
  Phylum:  Proteobacteria; Class: Gammaproteobacteria; Order: Enterobacteriales; Family: Enterobacteriaceae
tacacatgcagtcgaacggtagcacagagagcttgctctcgggtgacgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtggagttaataccttcaccgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggcttaacctgggaactgcattcgaaactggcaggctggagtcttgtagaggggggtagaattccaggtgtagcggtgaaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacggggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttga

SEQ ID NO: 780 - DNA, 1426 bp, Pantoea sp.
  Phylum:  Proteobacteria; Class: Gammaproteobacteria; Order: Enterobacteriales; Family: Enterobacteriaceae
accatgcagtcggacggtagcacagaggagcttgctcctcgggtgacgagtggcggacgggtgagtagtgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcacccatgccgcgtgtatgaagacggcctttcgcgggttgtaaagtactttccaagcggggaggaaggcgatgaggttaataaccttgttgattgacgttacccgcaggaagaagcaccggctaactccgtgccagcagccgcggtaatacggagggtgcaagcgttaatcggaattactgggcgtaaagcgcacgcaggcggtctgttaagtcagatgtgaaatccccgggcttaaccctgggaactgcatttgaaactggcaggcttgagtctcgtagaggggggtagaattccaggtgtagcggtgaaatgcgtagagatctggaggaataccggtggcgaaggcggccccctggacgaagactgacgctcacgtgcgaaagcgtggggagcaaacacgattacataccctggtagtccacgccgtaaacgatgtcgacttggaggttgttcccttgaggagtggcttcccgagctaacgcgttaagtcgaccgcctggcgagtacggccgcaaggttaaaactcaaatgaattgacgggggcccgcacaagcggtggagcatgtggtttaattccatgcatcgcgaagaaccttacctactcttgacatccaccgaacttagggcagagatgccttggtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgctaccact

SEQ ID NO: 781 - DNA, 1420 bp, Pantoea sp.
  Phylum:  Proteobacteria; Class: Gammaproteobacteria; Order: Enterobacteriales; Family: Enterobacteriaceae
accatgcagtcggacggtagcacagaggagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcagtgaggttaataaccttactgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggcccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaacctccgggagggcgcttaccactt

SEQ ID NO: 782 - DNA, 1415 bp, Unknown
  Description of Unknown: Polynucleotide
  Phylum:  Proteobacteria; Class: Gammaproteobacteria; Order: Enterobacteriales; Family: Enterobacteriaceae
gcagtcggacggtagcacagaggagcttgctcctcgggtgacgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagcttgtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtggtgaggttaataacctcatcaattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtgggtttaattcgatgcaacgcgaagaaccttacctactcttgacatccagcgaactttccagagatgggattggtgccttcgggaacgctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccctcgggagggcgctaccatag

SEQ ID NO: 783 - DNA, 1398 bp, Unknown
  Description of Unknown: Polynucleotide
  Phylum:  Proteobacteria; Class: Gammaproteobacteria; Order: Enterobacteriales; Family: Enterobacteriaceae
caacagaggagcttgctcctcgggtgacgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagcttgtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtggtgaggttaataacctcatcaattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagcgaactttccagagatggattggtgccttcgggaacgctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccctcgggagggcgctaccata

SEQ ID NO: 784 - DNA, 1415 bp, Pantoea sp.
  Phylum:  Proteobacteria; Class: Gammaproteobacteria; Order: Enterobacteriales; Family: Enterobacteriaceae
atgcagtcggacggtagcacagaggagcttgctcctcgggtgacgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagcttgtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgctgaggttaataacctcatcaattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagcgaactttccagagatggattggtgccttcgggaacgctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccctcgggagggcgctaccatag

SEQ ID NO: 785 - DNA, 1416 bp, Enterobacter sp.
  Phylum:  Proteobacteria; Class: Gammaproteobacteria; Order: Enterobacteriales; Family: Enterobacteriaceae
cacatgcagtcgaacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccgcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccatat

SEQ ID NO: 786 - DNA, 1415 bp, Unknown
  Description of Unknown: Polynucleotide
  Phylum:  Proteobacteria; Class: Gammaproteobacteria; Order: Enterobacteriales; Family: Enterobacteriaceae
catgcagtcggacggtagcacagaggagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacctcaccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatggtttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgctacccat

SEQ ID NO: 787 - DNA, 1413 bp, Pseudomonas sp.
  Phylum:  Proteobacteria; Class: Gammaproteobacteria; Order: Pseudomonadales; Family: Pseudomonadaceae
acacatgcagtcgagcggatgatgggagcttgctcctggattcagcggcggacgggtgagtaatgcctaggaatctgcctggtagtgggggacaacgtttcgaaaggaacgctaataccgcatacgtcctacgggagaaagcaggggaccttcgggccttgcgctatcagatgagcctaggtcggattagcttgttggtgaggtaatggctcaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggtcttcggattgtaaagcactttaagttgggaggaagggttgtagattaatactctgcaattttgacgttaccgacagaataagcaccggctaactctgtgccagcagccgcggtaatacagagggtgcaagcgttaatcggaattactgggcgtaaagcgcgcgtaggtggtttgttaagttggatgtgaaagccccgggctcaacctgggaactgcatccaaaactggcaagctagagtacggtagagggtggtggaatttcctgtgtagcggtgaaatgcgtagatataggaaggaacaccagtggcgaaggcgaccacctggactgatactgacactgaggtgcgaaagcgtggggagcaaacaggattagataccctggtagtccacgccgtaaacgatgtcaactagccgttggaatccttgagattttagtggcgcagctaacgcattaagttgaccgcctggggagtacggccgcaaggttaaaactcaaatgaattgacgggggcccgcacaagcggtggagcatgtggtttaattcgaagcaacgcgaagaaccttaccaggccttgacatgcagagaactttccagagatggattggtgccttcgggaactctgacacaggtgctgcatggctgtcgtcagctcgtgtcgtgagatgttgggttaagtcccgtaacgagcgcaacccttgtccttagttaccagcacgttaaggtgggcactctaaggagactgccggtgacaaaccggaggaaggtggggatgacgtcaagtcatcatggcccttacggcctgggctacacacgtgctacaatggtcggtacagagggttgccaagccgcgaggtggagctaatctcacaaaaccgatcgtagtccggatcgcagtctgcaactcgactgcgtgaagtcggaatcgctagtaatcgcgaatcagaatgtcgcggtgaatacgttcccgggccttgtacacaccgcccgtcacaccatgggagtgggttgcaccagaagtagctagtctaaccttcgggaggacggtaccacg

SEQ ID NO: 788 - DNA, 1415 bp, Pseudomonas oryzihabitans
  Phylum:  Proteobacteria; Class: Gammaproteobacteria; Order: Pseudomonadales; Family: Pseudomonadaceae
acacatgcagtcgagcggatgagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccctcgggtcgtaaagcactttaagttgggaggaagggctcatagcgaatacctgtgagttttgacgttaccaacagactaagcaccggctaacttcgtgccagcagccgcggtaatacgaagggtgcaagcgttaatcggaattactgggcgtaaagcgcgcgtaggtggcttgataagttgggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgccttgatgcttacctggccttgacatgctgagaacctttcagagatggatacgtgccttcgggaactctcagactcgtgctgcatggctgtcgtcagctcgtgtcgtgagatgttgggttaagtcccgatacgagcgcaacggtactggtaagttaccagcacatcatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacggtaccacga

SEQ ID NO: 789 - DNA, 1415 bp, Pseudomonas oleovorans
  Phylum:  Proteobacteria; Class: Gammaproteobacteria; Order: Pseudomonadales; Family: Pseudomonadaceae
acacatgcagtcgagcggatgagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccctcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacggggggcccgcacaagcggtggagcatggtggtttaattcgaagcaacgcgaagtaccttacctggccttgacatgctgagaaccttgcagagatggattggtgccttcgggaactcagacacaggtgctgcatggctgtcgtcagctcgtgtcgtgagatgttgggttaagtcccgtaacgagcgcaacccttgtccttagttaccagcacatcatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacggtaccacg

SEQ ID NO: 790 - DNA, 1418 bp, Pseudomonas oryzihabitans
  Phylum:  Proteobacteria; Class: Gammaproteobacteria; Order: Pseudomonadales; Family: Pseudomonadaceae
acacatgcagtcgagcggatgagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccctcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagatgcttacctggccttgacatgctgagaacattgcagagatggatatgtgccttcgggaactcagacacaggtgctgcatggctgtcgtcagctcgtgtcgtgagatgttgggttaagtcccgtaacgagcgcaacccttgtccttagttaccagcacatcatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacggtaccacggagta

SEQ ID NO: 791 - DNA, 1407 bp, Pseudomonas oryzihabitans
  Phylum:  Proteobacteria; Class: Gammaproteobacteria; Order: Pseudomonadales; Family: Pseudomonadaceae
catgcagtcgagcggatgagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccctcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgttctagcttacctggccttgacatgctgagaacattgcagagatgctatgctgccttccgggactcagacacaggtgctgcatggctgtcgtcagctcgtgtcctgagatgatcggttaagtcccgtaacgagcgcaacccttgtccttagtatccagcacatcatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacggtacc

SEQ ID NO: 792 - DNA, 1416 bp, Pseudomonas psychrotolerans
  Phylum:  Proteobacteria; Class: Gammaproteobacteria; Order: Pseudomonadales; Family: Pseudomonadaceae
acatgcaagtcgagcggatgagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggcttacagcgaatacctgtgagttttgacgttaccgacagaataagcaccggctaacttcgtgccagcagccgcggtaatacgaagggtgcaagcgttaatcggaattactgggcgtaaagcgcgcgtaggtggcttgataagttggatgtgaaatcccccgggctcaacctgggaactgcatccaaaactgtctggctagagtgtggtagagggtagtggaatttcccagtgtagcggtgaaatgcgtagatattggaaggaacaccagtggcgaaggcgactacctggactaacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggtttagtcccgtaacgagcgcaacccttgtccttagttaccagcacattatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacggtaccacgga

SEQ ID NO: 793 - DNA, 1412 bp, Pseudomonas psychrotolerans
  Phylum:  Proteobacteria; Class: Gammaproteobacteria; Order: Pseudomonadales; Family: Pseudomonadaceae
catgcagtcgagcggatgagaggagcttgctcctcgattcagcggcggacgggtgagtaatgcctaggaatctgcccagtagtgggggacaacgtttcgaaaggaacgctaataccgcatacgtcctacgggagaaagtgggggatcttcggacctcacgctattggatgagcctaggtcggattagctagttggtggggtaacggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccctcgggtcgtaaagcactttaagttgggaggaagggcttacagcgaaatacctgtgagttttgacgttaccaacagaataaagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggattaattcgaagcaacgcgaagaaaccttacctggccatgacttgctgagaactttccagaacatggattggtgccttcgggtactcagacacaggtgctgcatggctgtcgtcagctcgtgtcgtgagatgttgggttaagtcccgtaacgagcgcaacccttgtccttagttaccagcacgtcatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccttcggggggacggtacca

SEQ ID NO: 794 - DNA, 1388 bp, Pseudomonas oryzihabitans
  Phylum:  Proteobacteria; Class: Gammaproteobacteria; Order: Pseudomonadales; Family: Pseudomonadaceae
gtagcagtcgtgcgggtgtaagacgcgatgattgctcctcgattcagcggcggacgggtgagtaatggctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggcttacagcgaatacctgtgagttttgacgttaccgacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgtggtagagggtagtggaatttccagtgtagcggtgaaatgcgtagatattggaaggaacaccagtggcgaaggcgactacctggactaacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtgggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagtag

SEQ ID NO: 795 - DNA, 1373 bp, Pseudomonas sp.
  Phylum:  Proteobacteria; Class: Gammaproteobacteria; Order: Pseudomonadales; Family: Pseudomonadaceae
agaggagcttgctcctcgattcagcggcggacgggcgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaacta

SEQ ID NO: 796 - DNA, 1405 bp, Pseudomonas sp.
  Phylum:  Proteobacteria; Class: Gammaproteobacteria; Order: Pseudomonadales; Family: Pseudomonadaceae
cacatgcagtcgagcggatgagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccttcgggaggacgg

SEQ ID NO: 797 - DNA, 1410 bp, Pseudomonas sp.
  Phylum:  Proteobacteria; Class: Gammaproteobacteria; Order: Pseudomonadales; Family: Pseudomonadaceae
tgcagtcgagcggatgagaggagcttgctcttcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacggtaccactag

SEQ ID NO: 798 - DNA, 1403 bp, Pseudomonas sp.
  Phylum:  Proteobacteria; Class: Gammaproteobacteria; Order: Pseudomonadales; Family: Pseudomonadaceae
atgcagtcgagcggatgagaggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccttcgggtcgtaaagcactttaagttgggaggaagggctcacagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaaccctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgttatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccctcgggaggacgg

SEQ ID NO: 799 - DNA, 1417 bp, Pseudomonas sp.
  Phylum:  Proteobacteria; Class: Gammaproteobacteria; Order: Pseudomonadales; Family: Pseudomonadaceae
atgcaagtcgagcggatgaggggagcttgctcctcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccctcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctgggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaaccttcgggaggacggtaccacggagtat

SEQ ID NO: 800 - DNA, 1392 bp, Pseudomonas sp.
  Phylum:  Proteobacteria; Class: Gammaproteobacteria; Order: Pseudomonadales; Family: Pseudomonadaceae
tcgagcggatgagaggagcttgctcttcgattcagcggcggacgggtgagtaatgcctaggaatctgcctagtagtgggggacaacgtttcgaaaggaacgctaataccgcatacgtcctacgggagaaagtgggggatcttcggacctcacgctattagatgagcctaggtcggattagctagttggtagggtaaaggcctaccaaggcgacgatccgtaactggtctgagaggatgatcagtcacactggaactgagacacggtccagactcctacgggaggcagcagtggggaatattggacaatgggcgaaagcctgatccagccatgccgcgtgtgtgaagaaggccctcgggtcgtaaagcactttaagttgggaggaagggctcatagcgaatacctgtgagttttgacgttaccaacagaataagcaccggctaacttcgtgccagcagccgcggtaatacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacaggattagataccctggtagtccacgccgtaaacgatgtcaactagccgttgggatccttgagatcttagtggcgcagctaacgcattaagttgaccgcctggggagtacggccgcaaggttaaaactcaaatgaattgacgggggcccgcacaagcggtggagcatgtggtttaattcgaagcaacgcgaagaaccttacctggccttgacatgctgagaactttccagagatggattggtgccttcgggaactcagacacaggtgctgcatggctgtcgtcagctcgtgtcgtgagatgttgggttaagtcccgtaacgagcgcaacccttgtccttagttaccagcacgtaatggtgggcactctaaggagactgccggtgacaaaccggaggaaggtggggatgacgtcaagtcatcatggcccttacggccagggctacacacgtgctacaatggtcggtacaaagggttgccaagccgcgaggtggagctaatcccataaaaccgatcgtagtccggatcgcagtctgcaactcgactgcgtgaagtcggaatcgctagtaatcgtgaatcagaacgtcacggtgaatacgttcccgggccttgtacacaccgcccgtcacaccatgggagtgggttgctccagaagtagctagtctaacctcgggagga

SEQ ID NO: 801 - DNA, 1401 bp, Curtobacterium  citreum
  Phylum:  Actinobacteria; Class: Actinobacteria; Order: Actinomycetales; Family: Microbacteriaceae
taccatgcagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagcttacgcattaagcgccccgcctggggagtacggccgcaaggctaaaactcaaaggaattgacgggggcccgcacaagcggcggagcatgcggattaattcgatgcaacgcgaagaagcttaccaaggcttgacatacaccggaaacggccagagatggttggccccttgtggtcggtgtacaggtggtgcatggatgtcgtcagctcgtgtcgtgacatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcgaaagt

SEQ ID NO: 802 - DNA, 1404 bp, Curtobacterium sp.
  Phylum:  Actinobacteria; Class: Actinobacteria; Order: Actinomycetales; Family: Microbacteriaceae
cacatgcagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaaggcttgacatacaccggaaacggccagagatggttgcccccgttgtggtcggtgtacaggtggagcatggggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcgaatg

SEQ ID NO: 803 - DNA, 1397 bp, Curtobacterium sp.
  Phylum:  Actinobacteria; Class: Actinobacteria; Order: Actinomycetales; Family: Microbacteriaceae
catgcagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcgaa

SEQ ID NO: 804 - DNA, 1395 bp, Curtobacterium sp.
  Phylum:  Actinobacteria; Class: Actinobacteria; Order: Actinomycetales; Family: Microbacteriaceae
ccatgcagtcgacgatgatgcccagcttgctgggtggattagtggcgaacgggtgagtaacacgtgagtaacctgcccctgactctgggataagcgttggaaacgacgtctaatactggatatgaccgccgatcgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacgggcagagatggtcgcccccttggtggtcggtgtacaggtggtgcatgggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcg

SEQ ID NO: 805 - DNA, 1399 bp, Curtobacterium sp.
  Phylum:  Actinobacteria; Class: Actinobacteria; Order: Actinomycetales; Family: Microbacteriaceae
catgcagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacagccagagatggttgcccccttgtggtcggtgtacacgtggtgcatgggttgtcgtcagctcgtgtcgtgacttgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcgaatgg

SEQ ID NO: 806 - DNA, 1410 bp, Curtobacterium sp.
  Phylum:  Actinobacteria; Class: Actinobacteria; Order: Actinomycetales; Family: Microbacteriaceae
accatgcagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaaaccctcttttagtagggaagaagcgtaagtgacggtacctgcagaaaaaagcaccgggctaactacgtgccagcagccgcggtaatacgtagggtgcaagcgttgtccgggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacagccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcgaaggtgattc

SEQ ID NO: 807 - DNA, 1393 bp, Curtobacterium sp.
  Phylum:  Actinobacteria; Class: Actinobacteria; Order: Actinomycetales; Family: Microbacteriaceae
caagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgccaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcgaa

SEQ ID NO: 808 - DNA, 1399 bp, Curtobacterium sp.
  Phylum:  Actinobacteria; Class: Actinobacteria; Order: Actinomycetales; Family: Microbacteriaceae
taccatgcagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcgaag

SEQ ID NO: 809 - DNA, 1399 bp, Curtobacterium sp.
  Phylum:  Actinobacteria; Class: Actinobacteria; Order: Actinomycetales; Family: Microbacteriaceae
atgcagtcgaacgatgatgcccagcttgctgggtggattagtggcgaacgggtgagtaacacgtgagtaacctgcccctgactctgggataagcgttggaaacgacgtctaatactggatatgatcactggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggcctttccgggttgtaaacctcttttagtagggaagaaagcgaaagtgacggtaccttgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcatggggagcgaacaggattagataccctggtagtccatgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacgggccagagatggtcgcccccttgtggtcggtgtacaggtggtgcatggttgtcgtcagctcgtgtcgtgagatgttgggttaagtcccgcaacgagcgcaaccctcgttctatgttgccagcgggttatgccggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcgaa

SEQ ID NO: 810 - DNA, 1391 bp, Curtobacterium sp.
  Phylum:  Actinobacteria; Class: Actinobacteria; Order: Actinomycetales; Family: Microbacteriaceae
acatgcagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccgggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaagggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagc

SEQ ID NO: 811 - DNA, 1382 bp, Curtobacterium sp.
  Phylum:  Actinobacteria; Class: Actinobacteria; Order: Actinomycetales; Family: Microbacteriaceae
tgtagtcgacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggtcgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaagg

SEQ ID NO: 812 - DNA, 1393 bp, Curtobacterium sp.
  Phylum:  Actinobacteria; Class: Actinobacteria; Order: Actinomycetales; Family: Microbacteriaceae
atgcaagtcgaacgatgatcaggagcttgctcctgtgattagtggcgaacgggtgagtaacacgtgagtaacctgcccctgactctgggataagcgttggaaacgacgtctaatactggatatgatcactggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccgggaaatgggccagagatggtcgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgt

SEQ ID NO: 813 - DNA, 1389 bp, Curtobacterium sp.
  Phylum:  Actinobacteria; Class: Actinobacteria; Order: Actinomycetales; Family: Microbacteriaceae
cagcagtcgacgatgaagcccagcttgctgggtggattagtggcgaacgggtgagtaacacgtgagtaacctgcccctgactctgggataagcgttggaaacgacgtctaatactggatatgactactggtcgcatggcctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggtcgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccga

SEQ ID NO: 814 - DNA, 1390 bp, Curtobacterium sp.
  Phylum:  Actinobacteria; Class: Actinobacteria; Order: Actinomycetales; Family: Microbacteriaceae
acatgcaagtcgaacgatgatgcccagcttgctgggtggattagtggcgaacgggtgagtaacacgtgagtaacctgcccctgactctgggataagcgttggaaacgacgtctaatactggatatgactactggtcgcatggcctggtggtggaaagattctttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggtcgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagc

SEQ ID NO: 815 - DNA, 1397 bp, Curtobacterium sp.
  Phylum:  Actinobacteria; Class: Actinobacteria; Order: Actinomycetales; Family: Microbacteriaceae
taccatgcagtcgaacgatgatcaggagcttgctcttgtgattagtggcgaacgggtgagtaacacgtgagtaacctgcccctgactctgggataagcgttggaaacgacgtctaatactggataggactactggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgcccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcatggggagcgaacaggattagataccctggtagtccatgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggtcgcccccttgtcgtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcg

SEQ ID NO: 816 - DNA, 1398 bp, Curtobacterium sp.
  Phylum:  Actinobacteria; Class: Actinobacteria; Order: Actinomycetales; Family: Microbacteriaceae
tacacatgcagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaagggcttgacatacaccgggaaacggccagagatggatcgccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtc

SEQ ID NO: 817 - DNA, 1390 bp, Curtobacterium sp.
  Phylum:  Actinobacteria; Class: Actinobacteria; Order: Actinomycetales; Family: Microbacteriaceae
catgcagtcgacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgt

SEQ ID NO: 818 - DNA, 1369 bp, Curtobacterium sp.
  Phylum:  Actinobacteria; Class: Actinobacteria; Order: Actinomycetales; Family: Microbacteriaceae
tcgacgatgatgcccagcttgctgggtggattagtggcgaacgggtgagtaacacgtgagtaacctgcccctgactctgggataagcgttggaaacgacgtctaatactggatacgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggtcgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaaccctg

SEQ ID NO: 819 - DNA, 1385 bp, Curtobacterium sp.
  Phylum:  Actinobacteria; Class: Actinobacteria; Order: Actinomycetales; Family: Microbacteriaceae
cagtcgacgatgatgcccagcttgctgggtggattagtggcgaacgggtgagtaacacgtgagtaacctgcccctgactctgggataagcgttggaaacgacgtctaatactggatacgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaacgcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggtcgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagcct

SEQ ID NO: 820 - DNA, 1395 bp, Curtobacterium sp.
  Phylum:  Actinobacteria; Class: Actinobacteria; Order: Actinomycetales; Family: Microbacteriaceae
ccatgcagtcgaacgatgatgcccagcttgctgggtggattagtggcgaacgggtgagtaacacgtgagtaacctgcccctgactctgggataagcgttggaaacgacgtctaatactggatatgactgccggccgcatggtctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgtaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggttgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgtcga

SEQ ID NO: 821 - DNA, 1393 bp, Curtobacterium sp.
  Phylum:  Actinobacteria; Class: Actinobacteria; Order: Actinomycetales; Family: Microbacteriaceae
acatgcaagtcgaacgatgaagcccagcttgctgggtggattagtggcgaacgggtgagtaacacgtgagtaacctgcccctgactctgggataagcgttggaaacgacgtctaatactggatatgactactggtcgcatggcctggtggtggaaagattttttggttggggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagtagggaagaagcgaaagtgacggtacctgcagaaaaagcaccggctaactacgtgccagcagccgcggtaatacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacaggattagataccctggtagtccacgccgtaaacgttgggcgctagatgtagggacctttccacggtttctgtgtcgtagctaacgcattaagcgccccgcctggggagtacggccgcaaggctaaaactcaaaggaattgacgggggcccgcacaagcggcggagcatgcggattaattcgatgcaacgcgaagaaccttaccaaggcttgacatacaccggaaacggccagagatggtcgcccccttgtggtcggtgtacaggtggtgcatggttgtcgtcagctcgtgtcgtgagatgttgggttaagtcccgcaacgagcgcaaccctcgttctatgttgccagcgcgttatggcggggactcataggagactgccggggtcaactcggaggaaggtggggatgacgtcaaatcatcatgccccttatgtcttgggcttcacgcatgctacaatggccggtacaaagggctgcgataccgtaaggtggagcgaatcccaaaaagccggtctcagttcggattgaggtctgcaactcgacctcatgaagtcggagtcgctagtaatcgcagatcagcaacgctgcggtgaatacgttcccgggccttgtacacaccgcccgtcaagtcatgaaagtcggtaacacccgaagccggtggcctaacccttgtggaaggagccgt

SEQ ID NO: 822 - DNA, 1436 bp, Paenibacillus sp.
  Phylum:  Firmicutes; Class: Bacilli; Order: Bacillales; Family: Paenibacillaceae
atacatgcagtcgagcggacttgcatgagaagcttgcttctctgataggttagcggcggacgggtgagtaacacgtaggcaacctgccctcaagtttgggacaactaccggaaacggtagctaataccgaatagttgttttcttctcctgaaggaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagcccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaaggtcttgacatccctctgaccggtacagagatgtaccttttccttcgggacagaggagacaggtggtgcatgggttgtcgtcagctcgtgtcctgaagcatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaa

SEQ ID NO: 823 - DNA, 1442 bp, Paenibacillus sp.
  Phylum:  Firmicutes; Class: Bacilli; Order: Bacillales; Family: Paenibacillaceae
ctatacatgcaagtcgagcggacttgcatgagaagcttgcttctctgataggttagcggcggacgggtgagtaacacgtaggcaacctgccctcaagtttgggacaactaccggaaacggtagctaataccgaatagttgttttcttctcctgaagaaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaaggtgacggtacctgagaagaaagccccggctaactacgtgcccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgaccggtacagagatgtacctttccttcgggacagagcagacaggtggtgcatggttgtcgtcagctcgtgtcgtgagatgttgggttaagtcccgcaaggagccgcgatcccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaaggtgg

SEQ ID NO: 824 - DNA, 1441 bp, Paenibacillus sp.
  Phylum:  Firmicutes; Class: Bacilli; Order: Bacillales; Family: Paenibacillaceae
ctatacatgcaagtcgagcggacttgcatgagaagcttgcttctctgataggttagcggcggacgggtgagtaacacgtaggcaacctgccctcaagtttgggacaactaccggaaacggtagctaataccgaatagttgttttcttctcctgaagaaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgagcgggtacagagatgtaacgtttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaaggtgtt

SEQ ID NO: 825 - DNA, 1436 bp, Paenibacillus sp.
  Phylum:  Firmicutes; Class: Bacilli; Order: Bacillales; Family: Paenibacillaceae
aatacatgcagtcgagcggacttgcatgagaagcttgcttctctgatggttagcggcggacgggtgagtaacacgtaggcaacctgccctcaagcttgggacaactaccggaaacggtagctaataccgaatagttgttttcttctcctgaagaaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgcccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtgggtttaattcgaagcaacgcgaagaacccttaccaggtcttgacatccctctgaacgggtacagagatgtaacttttccttcgggacagaggacacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgatg

SEQ ID NO: 826 - DNA, 1429 bp, Paenibacillus sp.
  Phylum:  Firmicutes; Class: Bacilli; Order: Bacillales; Family: Paenibacillaceae
tacatgcagtcgagcggacttgcatgagaagcttgcttctctgataggttagcggcggacgggtgagtaacacgtaggcaacctgccctcaagcttgggacaactaccggaaacggtagctaataccgaatagttgttttcttctcctgaagaaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccctctgaccggtacagagatgtatctttccttcgggacagaggagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggctgtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgaa

SEQ ID NO: 827 - DNA, 1438 bp, Paenibacillus  amylolyticus
  Phylum:  Firmicutes; Class: Bacilli; Order: Bacillales; Family: Paenibacillaceae
actaatacatgcaagtcgagcggacttgatgagaagcttgcttctctgatgcgttagcggcggacgggtgagtaacacgtaggcaacctgccctcaagtttgggacaactaccggaaacggtagctaataccgaatagttgtttccttcgcctgaaggaaactggaaagacggagcaatctgtcacttggggatgggcctgcggcgcattagctagttggtggggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctccaaggtgacggtacctgagaagaaagccccggctaactacgtgccagcagccgcggtaatacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtgggagtatgtggtttaattcgaagcaacgcgaagaaccttaccaggtcttgacatccgaatgaccggtgcagagatgtaccttttcttcggaacattcaagacaggtggtgcatggttgtcgtcagctcgtgtcgtgagatgttgggttaagtcccgcaacgagcgcaacccttatatttagttgccagcacttcgggtgggcactctagatagactgccggtgacaaaccggaggaaggtggggatgacgtcaaatcatcatgccccttatgacctgggctacacacgtactacaatggccggtacaacgggctgcgaaatcgcgagatggagccaatcccaacaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagccgccgatg

SEQ ID NO: 828 - DNA, 1420 bp, Pantoea dispersa
  Phylum:  Proteobacteria; Class: Gammaproteobacteria; Order: Enterobacteriales; Family: Enterobacteriaceae
cacatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacctcgccgattgacgttacccgcagaagaagcaccggctaactccgtgccagcagccgcggtaatacggagggtgcaagcgttaatcggaattactgggcggtaaagcgcacgcaggcggtctgttaagtcagatgtgaaatccccgggcttaacctgggaactgcatttgaaactggcaggcttgagtctcgtagaggggggtagaattcccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagtagcttacctggccttgacatccagagaacatagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccactt

SEQ ID NO: 829 - DNA, 1419 bp, Pantoea dispersa
  Phylum:  Proteobacteria; Class: Gammaproteobacteria; Order: Enterobacteriales; Family: Enterobacteriaceae
cacatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagatgcttacctggccttgacatccagagaacatagcagagatgctttggtgccttgcggtactctgagacaggtgctgcatggctgtcgtcagctcgtgttgactaatgttgggttaagtcccgcatgctgcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccactta

SEQ ID NO: 830 - DNA, 1424 bp, Pantoea dispersa
  Phylum:  Proteobacteria; Class: Gammaproteobacteria; Order: Enterobacteriales; Family: Enterobacteriaceae
gctacacatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaacttgccgattgacgttacccgcagaagaagcaccggctaactccgtgccagcagccgcattaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaatagtagggttaagtcccggtacgagcgcaagccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccacttgg

SEQ ID NO: 831 - DNA, 1421 bp, Pantoea dispersa
  Phylum:  Proteobacteria; Class: Gammaproteobacteria; Order: Enterobacteriales; Family: Enterobacteriaceae
accatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacttctccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgatgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccacttgat

SEQ ID NO: 832 - DNA, 1420 bp, Pantoea dispersa
  Phylum:  Proteobacteria; Class: Gammaproteobacteria; Order: Enterobacteriales; Family: Enterobacteriaceae
accatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgtcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatggtggtttaattcgatgcaacgcgaagtagcttacctggccttgacatccagagaacttagcagagatgctttggtcgcttcgggaactctgacacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccacttt

SEQ ID NO: 833 - DNA, 1420 bp, Pantoea dispersa
  Phylum:  Proteobacteria; Class: Gammaproteobacteria; Order: Enterobacteriales; Family: Enterobacteriaceae
acacatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggctgtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacggggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgatgggataagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccactg

SEQ ID NO: 834 - DNA, 1420 bp, Pantoea dispersa
  Phylum:  Proteobacteria; Class: Gammaproteobacteria; Order: Enterobacteriales; Family: Enterobacteriaceae
accatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgtcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagtacttagcagagatgctttggtgccttcgggaactctgagacaggtgctgcatggctgtcgtcagctcgtgttgacaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccactttg

SEQ ID NO: 835 - DNA, 1418 bp, Pantoea dispersa
  Phylum:  Proteobacteria; Class: Gammaproteobacteria; Order: Enterobacteriales; Family: Enterobacteriaceae
catgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacgggccgcaaggttaaaactcaaatgaattgacggggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttcacaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccacct

SEQ ID NO: 836 - DNA, 1420 bp, Pantoea dispersa
  Phylum:  Proteobacteria; Class: Gammaproteobacteria; Order: Enterobacteriales; Family: Enterobacteriaceae
acacatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagacaacttagcacagatgctttggtgccttcgggaactctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccacttg

SEQ ID NO: 837 - DNA, 1410 bp, Pantoea dispersa
  Phylum:  Proteobacteria; Class: Gammaproteobacteria; Order: Enterobacteriales; Family: Enterobacteriaceae
gacagtcgaacggcagcacagaagaagcttgctctattgggtggcgagtggcggacggtggagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacctcgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacggggggcccgacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcataaagaagtagttagcttaaccttcgggagggctc

SEQ ID NO: 838 - DNA, 1409 bp, Pantoea sp.
  Phylum:  Proteobacteria; Class: Gammaproteobacteria; Order: Enterobacteriales; Family: Enterobacteriaceae
acagcagtcgacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacggggccccgcacaagccgtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcta

SEQ ID NO: 839 - DNA, 1416 bp, Pantoea dispersa
  Phylum:  Proteobacteria; Class: Gammaproteobacteria; Order: Enterobacteriales; Family: Enterobacteriaceae
cacatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattcccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaagcttacctggccttgacatccagagaacttagcagagatgctttggtgccttcgggaacttctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttac

SEQ ID NO: 840 - DNA, 1409 bp, Pantoea dispersa
  Phylum:  Proteobacteria; Class: Gammaproteobacteria; Order: Enterobacteriales; Family: Enterobacteriaceae
cgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaaacttagcagagatgctttggtgccttcgggaactctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccact

SEQ ID NO: 841 - DNA, 1409 bp, Pantoea dispersa
  Phylum:  Proteobacteria; Class: Gammaproteobacteria; Order: Enterobacteriales; Family: Enterobacteriaceae
agtcgacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccatc

SEQ ID NO: 842 - DNA, 1419 bp, Pantoea dispersa
  Phylum:  Proteobacteria; Class: Gammaproteobacteria; Order: Enterobacteriales; Family: Enterobacteriaceae
ctaccatgcagtcgacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctgggcttgacttccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccacga

SEQ ID NO: 843 - DNA, 1416 bp, Pantoea agglomerans
  Phylum:  Proteobacteria; Class: Gammaproteobacteria; Order: Enterobacteriales; Family: Enterobacteriaceae
acacatgcagtcgacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaaccctgggaactgcatttgaaactggcaggcttgagtctcgtagaggggggtagaattcccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggcgagtacggccgcaaggttaaaactcaaatgaattgacgggggccccgcacaagcggtggagcatgtggtttaattcgatgcaacgcgaagaaccttacctgggccttgacatccagactagatagcagacatgctttggtgccttcgggaactctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctt

SEQ ID NO: 844 - DNA, 1417 bp, Pantoea dispersa
  Phylum:  Proteobacteria; Class: Gammaproteobacteria; Order: Enterobacteriales; Family: Enterobacteriaceae
catgcagtcgacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacgggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccacttc

SEQ ID NO: 845 - DNA, 1414 bp, Pantoea brenneri
  Phylum:  Proteobacteria; Class: Gammaproteobacteria; Order: Enterobacteriales; Family: Enterobacteriaceae
ctaccatgcagtcgacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctca

SEQ ID NO: 846 - DNA, 1403 bp, Pantoea dispersa
  Phylum:  Proteobacteria; Class: Gammaproteobacteria; Order: Enterobacteriales; Family: Enterobacteriaceae
cagtcgacggcagcacagaatgagcttgctctttgggtggcgagtggcggacgggtgagtaatagtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtagttagcttaacctcgggagggct

SEQ ID NO: 847 - DNA, 1417 bp, Pantoea sp.
  Phylum:  Proteobacteria; Class: Gammaproteobacteria; Order: Enterobacteriales; Family: Enterobacteriaceae
cacatgcagtcgagcggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccac

SEQ ID NO: 848 - DNA, 1417 bp, Pantoea asburiae
  Phylum:  Proteobacteria; Class: Gammaproteobacteria; Order: Enterobacteriales; Family: Enterobacteriaceae
catgcagtcgacggcagcacagaagagcttgctctttgggtggcgagtggcggacgggtgagtaatgtctgggaaactgcccgatggagggggataactactggaaacggtagctaataccgcataacgtcgcgagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaatttccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtgggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccactt

SEQ ID NO: 849 - DNA, 1413 bp, Pantoea dispersa
  Phylum:  Proteobacteria; Class: Gammaproteobacteria; Order: Enterobacteriales; Family: Enterobacteriaceae
tcgacggcagcacagaagagcttgctctttgggtggcgagtggcggacgggtgagtaatgtctgggaaactgcccgatggagggggataactactggaaacggtagctaataccgcataacgtcgcgagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaaggtactttcagccgggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattcccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagaagaacttagcacagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccactt

SEQ ID NO: 850 - DNA, 1419 bp, Erwinia sp.
  Phylum:  Proteobacteria; Class: Gammaproteobacteria; Order: Enterobacteriales; Family: Enterobacteriaceae
cacatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacctcgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaagcttacctgggccttgacatccagagaacttagcagagatgctttggtgccttcggggactctgagacaggtgctgcatggctgtcgtcagctcgtgttgtgaaatgttgggttaagtcccgcaacgagcgcaacccttatcctttgttgccagcggttcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccattt

SEQ ID NO: 851 - DNA, 1417 bp, Erwinia sp.
  Phylum:  Proteobacteria; Class: Gammaproteobacteria; Order: Enterobacteriales; Family: Enterobacteriaceae
acacatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtgaggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacctcgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgctacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccac

SEQ ID NO: 852 - DNA, 1419 bp, Erwinia sp.
  Phylum:  Proteobacteria; Class: Gammaproteobacteria; Order: Enterobacteriales; Family: Enterobacteriaceae
acatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgcccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggcgagtacggccgcaaggttaaaactcaaatgaattgacgggggcccgcacaagcggtggagcatgtggtttaattcgatgcaacgcgaagaaccttacctgggccttgacatccagagaacttagcagagatgctttggacgcttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccatag

SEQ ID NO: 853 - DNA, 1388 bp, Erwinia sp.
  Phylum:  Proteobacteria; Class: Gammaproteobacteria; Order: Enterobacteriales; Family: Enterobacteriaceae
gcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagctt

SEQ ID NO: 854 - DNA, 1409 bp, Erwinia sp.
  Phylum:  Proteobacteria; Class: Gammaproteobacteria; Order: Enterobacteriales; Family: Enterobacteriaceae
cacatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacctcgccgattgacgttacccgcagaagaagcaccggctaactccgtgccagcagccgcggtaatacggagggtgcaagcgttaatcggaattactgggcgtaaagcgcacgcaggcggtcatgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggc

SEQ ID NO: 855 - DNA, 1419 bp, Erwinia sp.
  Phylum:  Proteobacteria; Class: Gammaproteobacteria; Order: Enterobacteriales; Family: Enterobacteriaceae
cacatgcagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacctcgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctgggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctactcata

SEQ ID NO: 856 - DNA, 1410 bp, Erwinia sp.
  Phylum:  Proteobacteria; Class: Gammaproteobacteria; Order: Enterobacteriales; Family: Enterobacteriaceae
tcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataacctcgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctgggccttgacatccagagaacttagcagagatgctttgggtgccttcgggaactctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccata

SEQ ID NO: 857 - DNA, 1413 bp, Erwinia sp.
  Phylum:  Proteobacteria; Class: Gammaproteobacteria; Order: Enterobacteriales; Family: Enterobacteriaceae
agtcgaacggcagcacagaagagcttgctctttgggtggcgagtggcggacgggtgagtaatgtctgggaaactgcccgatggagggggataactactggaaacggtagctaataccgcataacgtcgcgagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaaggcggccccctgggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccatag

SEQ ID NO: 858 - DNA, 1419 bp, Erwinia sp.
  Phylum:  Proteobacteria; Class: Gammaproteobacteria; Order: Enterobacteriales; Family: Enterobacteriaceae
acatgcaagtcgaacggcagcacagaagagcttgctctttgggtggcgagtggcggacgggtgagtaatgtctgggaaactgcccgatggagggggataactactggaaacggtagctaataccgcataacgtcgcgagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccatatt

SEQ ID NO: 859 - DNA, 1361 bp, Ochrobactrum sp.
  Phylum:  Proteobacteria; Class: Alphaproteobacteria; Order: Rhizobiales; Family: Brucellaceae
catgcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccactgtag

SEQ ID NO: 860 - DNA, 1360 bp, Ochrobactrum sp.
  Phylum:  Proteobacteria; Class: Alphaproteobacteria; Order: Rhizobiales; Family: Brucellaceae
catagcaagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaacccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagaatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccac

SEQ ID NO: 861 - DNA, 1365 bp, Ochrobactrum sp.
  Phylum:  Proteobacteria; Class: Alphaproteobacteria; Order: Rhizobiales; Family: Brucellaceae
acatgcaagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagaatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccactataat

SEQ ID NO: 862 - DNA, 1362 bp, Ochrobactrum sp.
  Phylum:  Proteobacteria; Class: Alphaproteobacteria; Order: Rhizobiales; Family: Brucellaceae
cacatgcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacggcggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccactgta

SEQ ID NO: 863 - DNA, 1355 bp, Ochrobactrum sp.
  Phylum:  Proteobacteria; Class: Alphaproteobacteria; Order: Rhizobiales; Family: Brucellaceae
catagcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgtcc

SEQ ID NO: 864 - DNA, 1367 bp, Ochrobactrum sp.
  Phylum:  Proteobacteria; Class: Alphaproteobacteria; Order: Rhizobiales; Family: Brucellaceae
catagcaagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttgggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgaagatgattgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccactatagt

SEQ ID NO: 865 - DNA, 1356 bp, Ochrobactrum sp.
  Phylum:  Proteobacteria; Class: Alphaproteobacteria; Order: Rhizobiales; Family: Brucellaceae
atagcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgtccac

SEQ ID NO: 866 - DNA, 1353 bp, Ochrobactrum sp.
  Phylum:  Proteobacteria; Class: Alphaproteobacteria; Order: Rhizobiales; Family: Brucellaceae
tgcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgtcca

SEQ ID NO: 867 - DNA, 1352 bp, Ochrobactrum sp.
  Phylum:  Proteobacteria; Class: Alphaproteobacteria; Order: Rhizobiales; Family: Brucellaceae
tagcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagcccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaacctgcaaggaggcaggcg

SEQ ID NO: 868 - DNA, 1361 bp, Ochrobactrum sp.
  Phylum:  Proteobacteria; Class: Alphaproteobacteria; Order: Rhizobiales; Family: Brucellaceae
atgcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccactatagt

SEQ ID NO: 869 - DNA, 1359 bp, Ochrobactrum sp.
  Phylum:  Proteobacteria; Class: Alphaproteobacteria; Order: Rhizobiales; Family: Brucellaceae
cacatgcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccact

SEQ ID NO: 870 - DNA, 1357 bp, Ochrobactrum sp.
  Phylum:  Proteobacteria; Class: Alphaproteobacteria; Order: Rhizobiales; Family: Brucellaceae
atgcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccacta

SEQ ID NO: 871 - DNA, 1355 bp, Ochrobactrum sp.
  Phylum:  Proteobacteria; Class: Alphaproteobacteria; Order: Rhizobiales; Family: Brucellaceae
agcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgtccact

SEQ ID NO: 872 - DNA, 1356 bp, Ochrobactrum sp.
  Phylum:  Proteobacteria; Class: Alphaproteobacteria; Order: Rhizobiales; Family: Brucellaceae
atgcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgaccact

SEQ ID NO: 873 - DNA, 1357 bp, Ochrobactrum sp.
  Phylum:  Proteobacteria; Class: Alphaproteobacteria; Order: Rhizobiales; Family: Brucellaceae
acatagcagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgtcca

SEQ ID NO: 874 - DNA, 1351 bp, Ochrobactrum sp.
  Phylum:  Proteobacteria; Class: Alphaproteobacteria; Order: Rhizobiales; Family: Brucellaceae
aagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgacca

SEQ ID NO: 875 - DNA, 1357 bp, Ochrobactrum sp.
  Phylum:  Proteobacteria; Class: Alphaproteobacteria; Order: Rhizobiales; Family: Brucellaceae
acatgcaagtcgagcgccccgcaaggggagcggcagacgggtgagtaacgcgtgggaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaaggcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgacca

SEQ ID NO: 876 - DNA, 1357 bp, Ochrobactrum sp.
  Phylum:  Proteobacteria; Class: Alphaproteobacteria; Order: Rhizobiales; Family: Brucellaceae
catgcaagtcgagcgccccgcaaggggagcggcagacgggtgagtaacgcgtgggcaacgtaccttttgctacggaataactcagggaaacttgtgctaataccgtatgtgcccttcgggggaaagatttatcggcaaaggatcggcccgcgttggattagctagttggtgaggtaaaggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccctagggttgtaaagctctttcaccggtgaagataatgacggtaaccggagaagaagccccggctaacttcgtgccagcagccgcggtaatacgaagggggctagcgttgttcggatttactgggcgtaaagcgcacgtaggcggacttttaagtcaggggtgaaatcccggggctcaaccccggaactgcctttgatactggaagtcttgagtatggtagaggtgagtggaattccgagtgtagaggtgaaattcgtagatattcggaggaacaccagtggcgaacgcggctcactggaccattactgacgctgaggtgcgaaagcgtggggagcaaacaggattagataccctggtagtccacgccgtaaacgatgaatgttagccgttggggagtttactcttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagcccttgacataccggtcgcggacacagagatgtgtctttcagttcggctggaccggatacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagcacgcgagtgtgagctaatctccaaaagccatctcagttcggattgcactctgcaactcgagtgcatgaagttggaatcgctagtaatcgcggatcagcatgccgcggtgaatacgttcccgggccttgtacacaccgcccgtcacaccatgggagttggttttacccgaaggcgctgtgctaaccgcaaggaggcaggcgacca

SEQ ID NO: 877 - DNA, 1423 bp, Stenotrophomonas maltophilia
  Phylum:  Proteobacteria; Class: Gammaproteobacteria; Order: Xanthomonadales; Family: Xanthomonadaceae
cacatgcaagtcgaacggcagcacagaggagcttgctccttgggtggcgagtggcggacgggtgaggaatacatcggaatctactttttcgtgggggataacgtagggaaacttacgctaataccgcatacgacctacgggtgaaagcaggggatcttcggaccttgcgcgattgaatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccataccgcgtgggtgaagaaggccttcgggttgtaaagcccttttgttgggaaagaaatccagccggctaatacctggttgggatgacggtacccaaagaataagcaccggctaacttcgtgccagcagccgcggtaatacgaagggtgcaagcgttactcggaattactgggcgtaaagcgtgcgtaggtggttgtttaagtctgttgtgaaagccctgggctcaacctgggaactgcagtggaaactggacaactagagtgtggtagagggtagcggaattcccggtgtagcagtgaaatgcgtagagatcgggaggaacatccatggcgaaggcagctaccctggaccaacactgacactgaggcacgaaagcgtggggagcaaacaggattagataccctggtagtccacgccctaaacgatgcgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaagcttacctggccttgacatgtcgagaactttccagagatggattggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgccacgg

SEQ ID NO: 878 - DNA, 1425 bp, Stenotrophomonas sp.
  Phylum:  Proteobacteria; Class: Gammaproteobacteria; Order: Xanthomonadales; Family: Xanthomonadaceae
accatgcaagtcgaacggcagcacagaggagcttgctccttgggtggcgagtggcggacgggtgaggaatacatcggaatctactctgtcgtgggggataacgtagggaaacttacgctaataccgcatacgacctacgggtgaaagcaggggatcttcggaccttgcgcgattgaatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccataccgcgtgggtgaagaaggccttcgggttgtaaagcccttttgttgggaaagaaatccatctggctaatacccgggtgggatgacggtacccaaagaataagcaccggctaacttcgtgccagcagccgcggtaatacgaagggtgcaagcgttactcggaattactgggcgtaaagcgtgcgtaggtggtcgtttaagtccgttgtgaaagcccctgggctcaacctgggaactgcagtggatactgggcgactagaatgtggtagagggtagcggaattcctggtgtagcagtgaaatgcgtagagatcaggaggaacatccatggcgaaggcagctacctggaccaacattgacactgaggcacgaaagcgtggggagcaaacaggattagataccctggtagtccacgccctaaacgatgcgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctgggccttgacatgtcgagaactttccagagatggatcggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtgagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgccacggt

SEQ ID NO: 879 - DNA, 1423 bp, Stenotrophomonas sp.
  Phylum:  Proteobacteria; Class: Gammaproteobacteria; Order: Xanthomonadales; Family: Xanthomonadaceae
ccatgcagtcgaacggcagcacagaggagcttgctccttgggtggcgagtggcggacgggtgaggaatacatcggaatctactctgtcgtgggggataacgtagggaaacttacgctaataccgcatacgacctacgggtgaaagcaggggatcttcggaccttgcgcgattgaatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccataccgcgtgggtgaagaaggccttcgggttgtaaagcccttttgttgggaaagaaatccatctggctaatacccgggtgggatgacggtacccaaagaataagcaccggctaacttcgtgccagcagccgcggtaatacgaagggtgcaagcgttactcgggaattactgggcgtaaagcgtgcgtaggtggtcgtttaagtccgttgtgaaagccctgggctcaacctgggaactgcagtggatactgggcgactagaatgtggtagagggtagcggaattcctggtgtagcagtgaaatgcgtagagatcaggaggaacatccatggcgaaggcagctacctggaccaacattgacactgaggcacgaaagcgtggggagcaaacaggattagataccctggtagtccacgccctaaacgatgcgaactggatgttgggtgcaatttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctgggccttgacatgtcgagaactttccagagatggatcggtgccttcgggaactcgaacacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacggccagggctacacacgtactacaatggtagggacagagggctgcaagccggcgacggtgagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgccacgga

SEQ ID NO: 880 - DNA, 1419 bp, Bacillus sp.
  Phylum:  Firmicutes; Class: Bacilli; Order: Bacillales; Family: Bacillaceae
atgcagtcgagcgaatggattaagagcttgctcttatgaagttagcggcggacgggtgagtaacacgtgggtaacctgcccataagactgggataactccgggaaaccggggctaataccggataatattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaagcttaccatggtcttgacatcctctgaaaaccctagagatagggcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaaccttttggagccagccg

SEQ ID NO: 881 - DNA, 1409 bp, Bacillus sp.
  Phylum:  Firmicutes; Class: Bacilli; Order: Bacillales; Family: Bacillaceae
cagtcgagcgatggattgagagcttgctctcaagaagttagcggcggacgggtgagtaacacgtgggtaacctgcccataagactgggataactccgggaaaccggggctaataccggataatattttgaactgcatggttcgaaattgaaaggcggcttcggctgtcacttatggatggacccgcgtcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtgctagttgaataagctggcaccttgacggtacctaaccagaaagccacggctaactacgtgccagcagccgcggtaatacgtaggtggcaagcgttatccgggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgaagttaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgaaaaccctagagatagggcttctccttcgggagcagagtgacaggtggtgcatggttgtcgtcagctcgtgtcgtgagatgttgggttaagtcccgcaacgagcgcaacccttgatcttagttgccatcattaagttgggcactctaaggtgactgccggtgacaaaccggaggaaggtggggatgacgtcaaatcatcatgccccttatgacctgggctacacacgtgctacaatggacggtacaaagagctgcaagaccgcgaggtggagctaatctcataaaaccgttctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacctttatggag

SEQ ID NO: 882 - DNA, 1403 bp, Achromobacter sp.
  Phylum:  Proteobacteria; Class: Betaproteobacteria; Order: Burkholderiales; Family: Alcaligenaceae
atgcagtcgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgtaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcatgagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccata

SEQ ID NO: 883 - DNA, 1408 bp, Achromobacter sp.
  Phylum:  Proteobacteria; Class: Betaproteobacteria; Order: Burkholderiales; Family: Alcaligenaceae
cacatgcagtcgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgtaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagaaccggtacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccactag

SEQ ID NO: 884 - DNA, 1402 bp, Achromobacter sp.
  Phylum:  Proteobacteria; Class: Betaproteobacteria; Order: Burkholderiales; Family: Alcaligenaceae
catgcagtcgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgtaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgatacca

SEQ ID NO: 885 - DNA, 1411 bp, Achromobacter sp.
  Phylum:  Proteobacteria; Class: Betaproteobacteria; Order: Burkholderiales; Family: Alcaligenaceae
tacacatgcagtcgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgtaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagatccggaacacaggtgctgcatggctgtcgtcagctcgtgtcgtgagatgttgggataagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccactagt

SEQ ID NO: 886 - DNA, 1405 bp, Achromobacter sp.
  Phylum:  Proteobacteria; Class: Betaproteobacteria; Order: Burkholderiales; Family: Alcaligenaceae
ccatgcagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattcggatgagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccata

SEQ ID NO: 887 - DNA, 1391 bp, Achromobacter sp.
  Phylum:  Proteobacteria; Class: Betaproteobacteria; Order: Burkholderiales; Family: Alcaligenaceae
cgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgcaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaacgcagcctcctgggataacactgacgctcatgcacgatagcgtggggagcaaacaggattagataccctggtagtccacgccctaaacgatgtcaactagctgttggggccttcgggccttgctagcgcagctaacgcgtgaagttgaccgcctggggagtacggtcgcaagattaatactcaaaggaattgacggggacccgcacaagcggtggatgatgtggattaattcgatgcaacgcgaaaaagcttacctacccttgacatgtctggaattccgaagagatttggcagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgata

SEQ ID NO: 888 - DNA, 1390 bp, Achromobacter sp.
  Phylum:  Proteobacteria; Class: Betaproteobacteria; Order: Burkholderiales; Family: Alcaligenaceae
agtcgacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgtaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcg

SEQ ID NO: 889 - DNA, 1407 bp, Achromobacter sp.
  Phylum:  Proteobacteria; Class: Betaproteobacteria; Order: Burkholderiales; Family: Alcaligenaceae
accatgcagtcgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgtaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccatag

SEQ ID NO: 890 - DNA, 1403 bp, Achromobacter sp.
  Phylum:  Proteobacteria; Class: Betaproteobacteria; Order: Burkholderiales; Family: Alcaligenaceae
catgcagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattcctgaagagatttgggaagtgctcgcaagagaatcgggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgatac

SEQ ID NO: 891 - DNA, 1404 bp, Achromobacter sp.
  Phylum:  Proteobacteria; Class: Betaproteobacteria; Order: Burkholderiales; Family: Alcaligenaceae
ccatgcagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattcggatctctttaggaagtgctcgcaagagaacccgtacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccag

SEQ ID NO: 892 - DNA, 1409 bp, Achromobacter sp.
  Phylum:  Proteobacteria; Class: Betaproteobacteria; Order: Burkholderiales; Family: Alcaligenaceae
taccatgcagtcgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgtaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccactag

SEQ ID NO: 893 - DNA, 1406 bp, Achromobacter sp.
  Phylum:  Proteobacteria; Class: Betaproteobacteria; Order: Burkholderiales; Family: Alcaligenaceae
ccatgcaagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattccgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccata

SEQ ID NO: 894 - DNA, 1410 bp, Achromobacter sp.
  Phylum:  Proteobacteria; Class: Betaproteobacteria; Order: Burkholderiales; Family: Alcaligenaceae
taccatgcaagtcgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgtaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccactag

SEQ ID NO: 895 - DNA, 1407 bp, Achromobacter sp.
  Phylum:  Proteobacteria; Class: Betaproteobacteria; Order: Burkholderiales; Family: Alcaligenaceae
accatgcagtcgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgtaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccata

SEQ ID NO: 896 - DNA, 1409 bp, Achromobacter sp.
  Phylum:  Proteobacteria; Class: Betaproteobacteria; Order: Burkholderiales; Family: Alcaligenaceae
accatgcaagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcatacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattccgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccactgt

SEQ ID NO: 897 - DNA, 1405 bp, Achromobacter sp.
  Phylum:  Proteobacteria; Class: Betaproteobacteria; Order: Burkholderiales; Family: Alcaligenaceae
ccatgcaagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattccgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccat

SEQ ID NO: 898 - DNA, 1411 bp, Achromobacter sp.
  Phylum:  Proteobacteria; Class: Betaproteobacteria; Order: Burkholderiales; Family: Alcaligenaceae
catgcaagtcgaacggcagcacggacttcggtctggtggcgagtggcgaacgggtgagtaatgtatcggaacgtgcccagtagcgggggataactacgcgaaagcgtagctaataccgcatacgccctacgggggaaagcaggggatcgtaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaaaggcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgataccactagtag

SEQ ID NO: 899 - DNA, 1401 bp, Achromobacter sp.
  Phylum:  Proteobacteria; Class: Betaproteobacteria; Order: Burkholderiales; Family: Alcaligenaceae
gcaagtcgaacggcagcacggacttcggtctggtggcgagtggcgaacgggtgagtaatgtatcggaacgtgcctagtagcgggggataactacgcgaaagcgtagctaataccgcatacgccctacgggggaaagcaggggatcgcaagaccttgcactattagagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggctaataccccgtgaaactgacggtacctgcagaataagcaccggctaactacgtgccagcagccgcggtaatacgtagggtgcaagcgttaatcggaattactgggcgtaaagcgtgcgcaggcggttcggaaagaaagatgtgaaatcccagagctcaactttggaactgcatttttaactaccgggctagagtgtgtcagagggaggtggaattccgcgtgtagcagtgaaatgcgtagatatgcggaggaacaccgatggcgaaaggcagcctcctgggataacactgacgctcatgcacgaaagcgtggggagcaaacaggattagataccctggtagtccacgccctaaacgatgtcaactagctgttggggccttcgggccttagtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaattccgaagagatttggaagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgatacca

SEQ ID NO: 900 - DNA, 1389 bp, Achromobacter sp.
  Phylum:  Proteobacteria; Class: Betaproteobacteria; Order: Burkholderiales; Family: Alcaligenaceae
acggcagcacggacttcggtctggtggcgagtggcgaacgggtgagtaatgtatcggaacgtgcccagtagcgggggataactacgcgaaagcgtagctaataccgcatacgccctacgggggaaagcaggggatcgtaagaccttgcactattggagcggccgatatcggattagctagttggtggggtaacggctcaccaaggcgacgatccgtagctggtttgagaggacgaccagccacactgggactgagacacggcccagactcctacgggaggcagcagtggggaattttggacaatgggggaaaccctgatccagccatcccgcgtgtgcgatgaaggccttcgggttgtaaagcacttttggcaggaaagaaacgtcatgggttaataccccgtgaaactgacggtacctgcagaataagcaccggctaactacgtgccagcagccgcggtaatacgtatggtgcaagcgttaatcggaattactgggcgtaaagcgtgcgcaggcggttcggaaagaaagatgtgaaatcccagagcttaactttggaactgcatttttaactaccgggctagagtgtgtcagagggaggtggaattccgcgtgtagcagtgaaatgcgtagatatgcggaggaacaccgatggcgaagcagcctcctgggataacactgacgctcatgcacgaaagcgtggggagcaaacaggattagataccctggtagtccacgccctaaacgatgtcaactagctgttggggccttcgggccttggtagcgcagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtctggaatgccgaagagatttggcagtgctcgcaagagaaccggaacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtcgggacagagggtcgccaacccgcgagggggagccaatcccagaaacccgatcgtagtccggatcgcagtctgcaactcgactgcgtgaagtcggaatcgctagtaatcgcggatcagcatgtcgcggtgaatacgttcccgggtcttgtacacaccgcccgtcacaccatgggagtgggttttaccagaagtagttagcctaaccgcaaggggggcgagacc

SEQ ID NO: 901 - DNA, 1421 bp, Enterobacter hermannii
  Phylum:  Proteobacteria; Class: Gammaproteobacteria; Order: Enterobacteriales; Family: Enterobacteriaceae
ctacacatgcagtcgaacggtaacaggaagcagcttgctgcttcgctgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgtggttaataaccgcgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaactttgcagagatgcattggtgccttcgggaactgtgagacaggtgctgcatggctgtcgtcagctcgtgttgtgaaatgttgggttaagtcccgcaacgagcgcaacccttatcctttgttgccagcggtcaggccgggaactcaaaggagactgccagtgataaactggaggaaggtggggatgacgtcaagtcatcatggcccttacgaccagggctacacacgtgctacaatggcgcatacaaagagaagcaatctcgcgagagctagcggacctcataaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggttgcaaaagaagtaggtagcttaaccttcgggagggcgctaccactt

SEQ ID NO: 902 - DNA, 1419 bp, Enterobacter hermannii
  Phylum:  Proteobacteria; Class: Gammaproteobacteria; Order: Enterobacteriales; Family: Enterobacteriaceae
cacatgcagtcgaacggtaacaggaagcagcttgctgctttgctgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgcggttaataaccgcgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaagcttacctggtcttgacatccacagaacttggcagagatgccttggtgccttcgggaactgtgagaacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcaatctcgcgagagctagcggacctcataaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggttgcaaaagaagtaggtagcttaaccttcgggagggcgctaccacat

SEQ ID NO: 903 - DNA, 1415 bp, Enterobacter hermannii
  Phylum:  Proteobacteria; Class: Gammaproteobacteria; Order: Enterobacteriales; Family: Enterobacteriaceae
catgcagtcgaacggtaacaggaagcagcttgctgctttgctgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgcggttaataaccgcgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagtacttggcagacatgccttggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcaatctcgcgagagctagcggacctcataaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggttgcaaaagaagtaggtagcttaaccttcgggagggcgctaccata

SEQ ID NO: 904 - DNA, 1419 bp, Enterobacter cloacae
  Phylum:  Proteobacteria; Class: Gammaproteobacteria; Order: Enterobacteriales; Family: Enterobacteriaceae
tgacagtcgacggtaacaggaagcagcttgctgctttgctgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgcggttaataaccgcgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatggtggtttaattcgatgcaacgcgaagaaacgttacctggtcttgacatccacagaactttggcagagatgccttggtgccttccggaactgtgacacacgtgctgcatggctgtcgtcagcctcgagttgagaaatggttagggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcaatctcgcgagagctagcggacctcataaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggttgcaaaagaagtaggtagcttaaccttcgggagggcgctaccatc

SEQ ID NO: 905 - DNA, 1422 bp, Enterobacter sp.
  Phylum:  Proteobacteria; Class: Gammaproteobacteria; Order: Enterobacteriales; Family: Enterobacteriaceae
cacatgcagtcgaacggtaacaggaagcagcttgctgcttcgctgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgtggttaataaccgcgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaaccctgggaactgcatccgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatgggatttggtgccttcgggaactgtgagacaggtgctgcatggctgtcgtcagctcgtgttgtgaaatgttgggataagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcaaactcgcgagagccagcggacctcataaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggttgcaaaagaagtaggtagcttaaccttcgggagggcgcttaccactt

SEQ ID NO: 906 - DNA, 1407 bp, Enterobacter sp.
  Phylum:  Proteobacteria; Class: Gammaproteobacteria; Order: Enterobacteriales; Family: Enterobacteriaceae
tcgacggtacaggaagcagcttgctgcttcgctgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgcggttaataaccgcgtcgattgacgttacccgcagaagaagcaccggctaactccgtgcccagcagccgcggtaatacggagggtgcaagcgttaatcggaattactgggcgtaaagcgcacgcaggcggtctgtcaagtcggatgtgaaatccccgggctcaacctgggaactgcatccgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtgggggagcaaacaggattagataccctggtagtccacgccgtaaacgatgtcgacttggaggttgtgcccttgaggcgtggcttccggagctaacgcgttaagtcgaccgcctggggagtacggccgcaagggttaaaactcaaatgaattgacgggggcccgcacaagcggtggagcatgtggtttaattcgatgcaacgcgaagaaccttacctggtcttgacatccacagaacttggcagagatgcaaaggtgccttcgggaactgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgatctcgcgagagccagcggacctcataaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggttgcaaaagaagtaggtagcttaaccttcgggagggcgctactc

SEQ ID NO: 907 - DNA, 1413 bp, Enterobacter sp.
  Phylum:  Proteobacteria; Class: Gammaproteobacteria; Order: Enterobacteriales; Family: Enterobacteriaceae
tgcagtcgaacggtaacaggaagcagcttgctgcttcgctgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgtggttaataaccgcgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaaccctgggaactgcatccgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacagaacttgccagagatgcgttggtgccttcgggtactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcgcatacaaagagaagcaatctcgcgagagctagcggacctcataaagtgcgtcgtagtccggattggagtctgcaactcgactccatgaagtcggaatcgctagtaatcgtgaatcagaatgtcacggtgaatacgttcccgggccttgtacacaccgcccgtcacaccatgggagtgggttgcaaaagaagtaggtagcttaaccttcgggagggcgctaccac

SEQ ID NO: 908 - DNA, 1430 bp, Bacillus  muralis
  Phylum:  Firmicutes; Class: Bacilli; Order: Bacillales; Family: Bacillaceae
tacatgcaagtcgagcgaatcgatgggagcttgctccctgagattagcggcggacgggtgagtaacacgtgggcaacctgcctataagactgggataacttcgggaaaccggagctaataccggatacgttcttttctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaagccacggctaactacgtgccagcagccgcggtaatacgtaggtggcaagcgttgtcccggaattattgggcgtaaagcgcgcgcaggtggttccttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggctttccccttcggggcacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaacctgcgaaggtaagcgaatcccataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccttcatggagccagccgcctaatg

SEQ ID NO: 909 - DNA, 1432 bp, Bacillus  muralis
  Phylum:  Firmicutes; Class: Bacilli; Order: Bacillales; Family: Bacillaceae
acatgcaagtcgagcgaatcgatgggagcttgctccctgagattagcggcggacgggtgagtaacacgtgggcaacctgcctataagactgggataacttcgggaaaccggagctaataccggatacgttcttttctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaacccagaaagccaacggctaactacgtgccagcagccgcggtaatacgtaggtggcaagcgttgtccggaattattgggcgtaaagcgcgcgcaggtggttcccttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggctttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaacctgcgaaggtaagcgaatcccataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccttcatggagccagccgcctaaagt

SEQ ID NO: 910 - DNA, 1433 bp, Bacillus sp.
  Phylum:  Firmicutes; Class: Bacilli; Order: Bacillales; Family: Bacillaceae
atactgcagtcgagcgaatcgatgggagcttgctccctgagattagcggcggacgggtgagtaacacgtgggcaacctgcctataagactgggataacttcgggaaaccggagctaataccggatacgttcttttctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaagccacggctaactacgtgcccagcagccgcggtaatacgtaggtggcaagcgttgtccggaattattgggcgtaaagcgcgcgcaggtggttccttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggcgagtacggccgcaaggctgaaactcaaaggaattgacgggggcccgcacaagcggtggagcatgtggtttaattcgaagcaacgcgaagaaccttaccaggtcttgacatcctctgacaaccctagagatagggctttcccctttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaacctgcgaaggtaagcgaatcccataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccttcatggagccagccgcctaagtgac

SEQ ID NO: 911 - DNA, 1426 bp, Bacillus  muralis
  Phylum:  Firmicutes; Class: Bacilli; Order: Bacillales; Family: Bacillaceae
gcaagtcgagcgaatcgatgggagcttgctccctgagattagcggcggacgggtgagtaacacgtgggcaacctgcctataagactgggataacttcgggaaaccggagctaataccggatacgttcttttctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaaagccacggctaactacgtgccagcagccgcggtaatacgtaggtggcaagcgttgtccggaattattgggcgtaaagcgcgcgcaggtggttcctttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccagggtcttgacatcctctgacaaccctagagatagggctttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaacctgcgaaggtaagcgaatcccataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccttcatggagccagccgcctaag

SEQ ID NO: 912 - DNA, 1429 bp, Bacillus  muralis
  Phylum:  Firmicutes; Class: Bacilli; Order: Bacillales; Family: Bacillaceae
tacatgcaagtcgagcgaatcagatgggagcttgctccctgagattagcggcggacgggtgagtaacacgtgggcaacctgcctataagactgggataacttcgggaaaccggagctaataccggatacgttcttttctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaagccacggctaactacgtgccagcagccgcggtaatacgtaggtggcaagcgttgtccggaattattgggcgtaaagcgcgcgcaggtggttctttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggctttccccttcgggcgtcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaacctgcgaaggtaagcgaatcccataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccttcatggagccagccgcctaag

SEQ ID NO: 913 - DNA, 1429 bp, Bacillus sp.
  Phylum:  Firmicutes; Class: Bacilli; Order: Bacillales; Family: Bacillaceae
ataatgcagtcgagcgaatcgatgggagcttgctccctgagattagcggcggacgggtgagtaacacgtgggcaacctgcctataagactgggataacttcgggaaaccggagctaataccggatacgttcttttctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaagccacggctaactacgtgccagcagccgcggtaatacgtaggtggcaagcgttgtccggaattattgggcgtaaagcgcgcgcaggtggttcctttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggctttccccttcgggggacagagtgacaggtgggagcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaacctgcgaaggtaagcgaatcccataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccttcatggagccagccgcctaag

SEQ ID NO: 914 - DNA, 1440 bp, Bacillus  muralis
  Phylum:  Firmicutes; Class: Bacilli; Order: Bacillales; Family: Bacillaceae
ctatactgcagtcgagcgaatcgatgggagcttgctccctgagattagcggcggacgggtgagtaacacgtgggcaacctgcctataagactgggataacttcgggaaaccggagctaataccggatacgttcttttctcgcatgagagaagatggaaagacggtttacgctgtcacttatagatgggcccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgaacgaagaaggccttcgggtcgtaaagttctgttgttagggaagaacaagtaccagagtaactgctggtaccttgacggtacctaaccagaaagccaccggctaactacgtgcccagcagccgcggtaatacgtaggtttggcaagcgattagaccggaattattggggccgtaaacccccccggctggaggttcccttactctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacaaccctagagatagggctttccccttcgggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggctgcaaacctgcgaaggtaagcgaatcccataaagccattctcagttcggattgcaggctgcaactcgcctgcatgaagccggaatcgctagtaatcgcggatcagcatgccgcggtgaatacgttcccgggccttgtacacaccgcccgtcacaccacgagagtttgtaacacccgaagtcggtgaggtaaccttcatggagccagccgcctaagg

SEQ ID NO: 915 - DNA, 1358 bp, Methylobacterium fujisawaense
  Phylum:  Proteobacteria; Class: Alphaproteobacteria; Order: Rhizobiales; Family: Methylobacteriaceae
aagcagtcgagcggacctttcggggtcagcggcggacgggtgagtaacgcgtgggaacgtgccttccggttcggaataaccctgggaaactagggctaataccggatacgcccttatggggaaaggtttactgccggaagatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttatccgggacgataatgacggtaccggaggaataagccccggctaacttcgtgccagcagccgcggtaatacgaagggggctagcgttgctcggaatcactgggcgtaaagggcgcgtaggcggcgttttaagtcgggggttgaaagcctgtggctcaacccacagaatggcctttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcaccgcagtagcgcagctaacgctttgagcattccgcctggcgagtacggtcgcaagattaaaactcaaaggaattgacgggggcccgcacaagcggtggagcatgtggtttaattcgaagcaacgcgcagaaccttaccatcctttgacatggcgtgttacccagagagatttggggtccacttcggtggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggacgcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggcgtccac

SEQ ID NO: 916 - DNA, 1360 bp, Methylobacterium sp.
  Phylum:  Proteobacteria; Class: Alphaproteobacteria; Order: Rhizobiales; Family: Methylobacteriaceae
ccatgcagtcgagcgggcccttcggggtcagcggcggacgggtgagtaacgcgtgggaacgtgccttctggttcggaataaccctgggaaactagggctaataccggatacgcccttttggggaaaggtttactgccggaagatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttatccgggacgataatgacggtactcggaggaataagccccggctaacttcgtgccagcagccgcggtaatacgaagggggctagcgttgctcggaatcactgggcgtaaagggcgcgtaggcggcgttttaagtcgggggtgaaagcctgtggctcaaccacagaatggccttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcaccgcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttacccagagagatctggggtccccttcgggggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggaggcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggcgaccactg

SEQ ID NO: 917 - DNA, 1363 bp, Methylobacterium sp.
  Phylum:  Proteobacteria; Class: Alphaproteobacteria; Order: Rhizobiales; Family: Methylobacteriaceae
atgcagtcgagcgggcccttcggggtcagcggcggacgggtgagtaacgcgtgggaacgtgccttctggttcggaataaccctgggaaactagggctaataccggatacgcccttttggggaaaggtttactgccggaagatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttaggggttgtaaagctcttttattccgggacgataatgacggtaccggaggaataagccccggctaacttcgtgccagcagccgcggtaatacgaagggggctagcgttgctcggaatcactgggcgtaaagggcgcgtaggcggcgttttaagtcgggggtgaaagcctgtggctcaaccacagaatggccttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcaccgcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttacccagagagatctggggtccccttcgggggcgcgcacacaggtgctgcatggctgtcgtcagctcgtgtcgtgagatgttgggttaagtcccgcaacgagcgcaacccacgtccttagttgccatcatttagttggggcactcttcggagactggcggtgattagccgcgaggaaggagtgggatgacgtcaaggtcctcatgggcccttacgggatgggctacacacgtgctacaatggcggtgacagtgggaggcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggcgaccactg

SEQ ID NO: 918 - DNA, 1362 bp, Methylobacterium sp.
  Phylum:  Proteobacteria; Class: Alphaproteobacteria; Order: Rhizobiales; Family: Methylobacteriaceae
taccatgcagtcgagcggacctttcggggtcagcggcggacgggtgagtaacgcgtgggaacgtgccttctggttcggaataaccctgggaaactagggctaataccggatacgcccttatggggaaaggtttactgccggaagatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttatccgggacgataatgacggtaccggaggaataagccccggctaacttcgtgccagcagccgcggtaatacgaagggggctagcgttgctcggaatcactgggcgtaaagggcgcgtaggcggcgttttaagtcgggggtgaaagcctgtggctcaaccacagaatggccttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacaggattagataccctggtagtccacgccgtaaacgatgaatgccagctgttggggtgcttgcaccgcagtagcgcagctaacgctttgagcattccgcctggggagtacggtcgcaagattaaaactcaaaggaattgacgggggcccgcacaagcggtggagcatgtggtttaattcgaagcaacgcgcagaaccttaccatcctttgacatggcgtgttacccagagagatttggggtccacttcggtggcgcgcacacaggtgctgcatggctgtcgtcagctcgtgtcgtgagatgttgggttaagtcccgcaacgagcgcaacccacgtccttagttgccatcattcagttgggcactctagggagactgccggtgataagccgcgaggaaggtgtggatgacgtcaagtcctcatggcccttacgggatgggctacacacgtgctacaatggcggtgacagtgggacgcgaaggagcgatctggagcaaatccccaaaagccgtctcagttcggattgcactctgcaactcgagtgcatgaaggcggaatcgctagtaatcgtggatcagcatgccacggtgaatacgttcccgggccttgtacacaccgcccgtcacaccatgggagttggtcttacccgacggcgctgcgccaaccgcaaggaggcaggcgaccacgat

SEQ ID NO: 919 - DNA, 1401 bp, Burkholderia  gladioli
  Phylum:  Proteobacteria; Class: Betaproteobacteria; Order: Burkholderiales; Family: Burkholderiaceae
ccatgcagtcgaacggcagcacgggtgcttgcacctggtggcgagtggcgaacgggtgagtaatacatcggaacatgtcctgtagtgggggatagcccggcgaaagccggattaataccgcatacgatccacggatgaaagcgggggaccttcgggcctcgcgctatagggttggccgatggctgattagctagttggtggggtaaaggcccaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctagagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggt

SEQ ID NO: 920 - DNA, 1396 bp, Burkholderia  gladioli
  Phylum:  Proteobacteria; Class: Betaproteobacteria; Order: Burkholderiales; Family: Burkholderiaceae
gaacggcagcacgggtgcttgcacctggtggcgagtggcgaacgggtgagtaatacatcggaacatgtcctgtagtgggggatagcccggcgaaagccggattaataccgcatacgatccacggatgaaagcgggggaccttcgggcctcgcgctatagggttggccgatggctgattagctagttggtggggtaaaggcccaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaaccctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttgggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctagagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcac

SEQ ID NO: 921 - DNA, 1386 bp, Burkholderia  gladioli
  Phylum:  Proteobacteria; Class: Betaproteobacteria; Order: Burkholderiales; Family: Burkholderiaceae
agcagtcgaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcccaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctggagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaacctg

SEQ ID NO: 922 - DNA, 1400 bp, Burkholderia  gladioli
  Phylum:  Proteobacteria; Class: Betaproteobacteria; Order: Burkholderiales; Family: Burkholderiaceae
aagtcgaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcccaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctggagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcacc

SEQ ID NO: 923 - DNA, 1388 bp, Burkholderia  gladioli
  Phylum:  Proteobacteria; Class: Betaproteobacteria; Order: Burkholderiales; Family: Burkholderiaceae
gaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcccaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctagagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaacctgcaaggagga

SEQ ID NO: 924 - DNA, 1394 bp, Burkholderia  gladioli
  Phylum:  Proteobacteria; Class: Betaproteobacteria; Order: Burkholderiales; Family: Burkholderiaceae
gaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcccaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctggagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcta

SEQ ID NO: 925 - DNA, 1390 bp, Burkholderia  gladioli
  Phylum:  Proteobacteria; Class: Betaproteobacteria; Order: Burkholderiales; Family: Burkholderiaceae
agcagtcgaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcccaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctagagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaacctgcaag

SEQ ID NO: 926 - DNA, 1401 bp, Burkholderia  gladioli
  Phylum:  Proteobacteria; Class: Betaproteobacteria; Order: Burkholderiales; Family: Burkholderiaceae
cagtcgaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcccaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctaccccttgacatggtcggaatcctagagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcacc

SEQ ID NO: 927 - DNA, 1403 bp, Burkholderia  gladioli
  Phylum:  Proteobacteria; Class: Betaproteobacteria; Order: Burkholderiales; Family: Burkholderiaceae
atgcagtcgaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcccaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgggtcggaatcctagagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcta

SEQ ID NO: 928 - DNA, 1405 bp, Burkholderia  gladioli
  Phylum:  Proteobacteria; Class: Betaproteobacteria; Order: Burkholderiales; Family: Burkholderiaceae
catgcagtcgaacggcagcacgggtgcttgcacctggtggcgagtggcgaacgggtgagtaatacatcggaacatgtcctgtagtgggggatagcccggcgaaagccggattaataccgcatacgatccacggatgaaagcgggggaccttcgggcctcgcgctatagggttggccgatggctgattagctagttggtggggtaaaggcccaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctggagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtctacc

SEQ ID NO: 929 - DNA, 1403 bp, Burkholderia  gladioli
  Phylum:  Proteobacteria; Class: Betaproteobacteria; Order: Burkholderiales; Family: Burkholderiaceae
accatgcagtcgacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcccaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctggagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtca

SEQ ID NO: 930 - DNA, 1401 bp, Burkholderia  gladioli
  Phylum:  Proteobacteria; Class: Betaproteobacteria; Order: Burkholderiales; Family: Burkholderiaceae
atgcagtcgacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcccaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctggagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcta

SEQ ID NO: 931 - DNA, 1406 bp, Burkholderia  gladioli
  Phylum:  Proteobacteria; Class: Betaproteobacteria; Order: Burkholderiales; Family: Burkholderiaceae
cacatgcagtcgaacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcccaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctagagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcacc

SEQ ID NO: 932 - DNA, 1399 bp, Burkholderia  gladioli
  Phylum:  Proteobacteria; Class: Betaproteobacteria; Order: Burkholderiales; Family: Burkholderiaceae
caagtcgacggcagcacgggtgcttgcacctggtggcgagtggcgaacgggtgagtaatacatcggaacatgtcctgtagtgggggatagcccggcgaaagccggattaataccgcatacgatctacggatgaaagcgggggaccttcgggcctcgcgctatagggttggccgatggctgattagctagttggtggggtaaaggcccaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctagagagatctgggagtgctcgaaagagaaccgatacacaggtgctgcatggctgtcgtcagctcgtgtcgtgagatgttgggttaagtcccgcaacgagcgcaacccttgtccttagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcac

SEQ ID NO: 933 - DNA, 1409 bp, Burkholderia  gladioli
  Phylum:  Proteobacteria; Class: Betaproteobacteria; Order: Burkholderiales; Family: Burkholderiaceae
taccatgcaagtcgaacggcagcacgggtgcttgcacctggtggcgagtggcgaacgggtgagtaatacatcggaacatgtcctgtagtgggggatagcccggcgaaagccggattaataccgcatacgatctacggaagaaagcgggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatcctgagggctaatatccttcggggatgacggtaccggaagaataagcaccggctaactacgtgccagcagccgcggtaatacgtagggtgcgagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgaggagactcgggagtgctcgaaagagaaccgatacacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgagggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcacc

SEQ ID NO: 934 - DNA, 1403 bp, Bacillus esteraromaticum
  Phylum:  Actinobacteria; Class: Actinobacteria; Order: Actinomycetales; Family: Microbacteriaceae
accatgcaagtcgaacgatgaagcccagcttgctgggtggattagtggcgaacgggtgagtaacacgtgagcaacctgcccctgactctgggataagcgctggaaacggtgtctaatactggatatgtcccatcaccgcatggtgtgtgggtggaaagatttttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggatgacggccttcgggttgtaaacctcttttagcagggaagaagcgagagtgacggtacctgcagaaaaagcaccggctaactacgtgccagcagccgcggtaatacgtagggtgcaagcgttatccggaattattgggcgtaaagagctcgtaggcggtttgtcgcgtctgctgtgaaattccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtgggggagcaaacaggcttagataccctggtagtccaccccgtaaacgttgggaactagttgtggggtcctttccacggattccgtgacgcagctaacgcattaagttccccgcctggggagtacggccgcaaggctaatactcaaaggaattgacggggacccgcacaagcggcggagcatgcggattaattcgatgcaacgcgaagaaccttaccaaggcttgacatacacgagaacgggccagaaatggtcaactctttcgacactcgtgaacagcaggtgcatggttgtcgtcagctcgtgtcgtggacaagttgggttatgtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaatgggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtcgaagg

SEQ ID NO: 935 - DNA, 1375 bp, Microbacterium trichothecenolyticum
  Phylum:  Actinobacteria; Class: Actinobacteria; Order: Actinomycetales; Family: Microbacteriaceae
acgatgaagcggtgcttgcaccgtggattagtggcgaacgggtgagtaacacgtgagcaacctgccctggactctgggataagcgctggaaacggtgtctaatactggatatgagctctcatcgcatggtgggggttggaaagattttttggtctgggatgggctcgcggcctatcagcttgttggtgaggtaatggcttaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgtgagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggtctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtagacgttgggaaactagttgtggggaccattccacggtttccgtgacgcagctaacgcattaagttccccgcctgggggagtacggccgcaaggctaaaactcaaaaggcaattgacggggacccgcacaagcggcggagcatgcggattaattcgatgcaacgcgaagaaccttaccaaggcttgacatacaccagaacaccgtagaaatacgggactctttggacactggtgaacaggtggtgcatggttgtcgtcagctcgtgtcgtgagatgttgggttaagtcccgcaacgagcgcaaccctcgttctatgttgccagcacgttatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtgga

SEQ ID NO: 936 - DNA, 1391 bp, Microbacterium pickettii
  Phylum:  Actinobacteria; Class: Actinobacteria; Order: Actinomycetales; Family: Microbacteriaceae
agcagtcgacggtgaaagagagcttgctctctggatcagtggcgaacgggtgagtaacacgtgagcaatctgcccctgactctgggataagcgctggaaacggcgtctaataccggatacgagctgcgaaggcatcttcagcagctggaaagaacttcggtcagggatgagctcgcggcctatcagctagttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaaacccgaggctcaacctcgggcctgcagtgggtacgggcagactagagtgcggtaggggagattggaattcctggtgtagcggtggaatgcgcagatatcaggaggaacaccgatggcgcaaaggcagatctctgggccgtaactgacgctgaggagcgaaagggtggggagcaaatcaggctttagataccctggtagtccaccccgtaaacgttgggaactagttgtggcgtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccatggcttgacatatacgagaacgctgcagaaatgtagaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtaaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagcct

SEQ ID NO: 937 - DNA, 1402 bp, Microbacterium  chocolatum
  Phylum:  Actinobacteria; Class: Actinobacteria; Order: Actinomycetales; Family: Microbacteriaceae
catgcaagtcgaacgatgaagcggtgcttgcaccgtggattagtggcgaacgggtgagtaacacgtgagcaacctgccctggactctgggataagcgctggaaacggtgtctaatactggatatgagctctcatcgcatggtgggggttggaaagattttttggtctgggatgggctcgcggcctatcagcttgttggtgaggtaatggcttaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgtgagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggtctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacggtttccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatacaccagaacaccgtagaaatacgggactctttggacactgggtgaacaggtggtgcatggttgtcgtcagctcgtggtcgtgagatgttgggttaagtcccgcaacgagcgcaaccctcgttctatgttgccagcacgttatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaaggtg

SEQ ID NO: 938 - DNA, 1394 bp, Microbacterium sp.
  Phylum:  Actinobacteria; Class: Actinobacteria; Order: Actinomycetales; Family: Microbacteriaceae
atgcagtcgaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtcg

SEQ ID NO: 939 - DNA, 1392 bp, Microbacterium  chocolatum
  Phylum:  Actinobacteria; Class: Actinobacteria; Order: Actinomycetales; Family: Microbacteriaceae
acttgcagtcgaacggtgaagccaagcttgcttggtggatcagtggcgaacgggtgagtaacacgtgagcaacctgccctggactctgggataagcgctggaaacggcgtctaatactggatatgagccttcatcgcatggtgggggttggaaagattttttggtctgggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacggtttccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatacaccagaacgggccagaaatggtcaactctttggacactggtgaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccta

SEQ ID NO: 940 - DNA, 1391 bp, Microbacterium  chocolatum
  Phylum:  Actinobacteria; Class: Actinobacteria; Order: Actinomycetales; Family: Microbacteriaceae
acatgcagtcgaacggtgaagccaagcttgcttggtggatcagtggcgaacgggtgagtaacacgtgagcaacctgccctggactctgggataagcgctggaaacggcgtctaatactggatatgagcctcttccgcatggtgggggttggaaagattttttggtctgggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacggtttccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatacaccagaacgggccagaaatggtcaactctttggacactggtgaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccg

SEQ ID NO: 941 - DNA, 1396 bp, Microbacterium sp.
  Phylum:  Actinobacteria; Class: Actinobacteria; Order: Actinomycetales; Family: Microbacteriaceae
gcaagtcgaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtaccctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtcgaa

SEQ ID NO: 942 - DNA, 1399 bp, Microbacterium sp.
  Phylum:  Actinobacteria; Class: Actinobacteria; Order: Actinomycetales; Family: Microbacteriaceae
acacatgcagtcgaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacagggtggtgcatgggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtc

SEQ ID NO: 943 - DNA, 1364 bp, Microbacterium sp.
  Phylum:  Actinobacteria; Class: Actinobacteria; Order: Actinomycetales; Family: Microbacteriaceae
cgatgaacctggagcttgctctgggggattagtggcgaacgggtgagtaacacgtgagcaacctgcccctgactctgggataagcgctggaaacggcgtctaatactggatacgaacaagaatcgcatggttacttgttggaaagattttttggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacggaccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaatgggcagcgataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaac

SEQ ID NO: 944 - DNA, 1393 bp, Microbacterium sp.
  Phylum:  Actinobacteria; Class: Actinobacteria; Order: Actinomycetales; Family: Microbacteriaceae
catgcagtcgaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtaccctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaatagctcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccg

SEQ ID NO: 945 - DNA, 1392 bp, Microbacterium sp.
  Phylum:  Actinobacteria; Class: Actinobacteria; Order: Actinomycetales; Family: Microbacteriaceae
catgcagtcgaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaagcttaccaaggcttgacatatacgagaacgggccagaaatggtcaactctttggacactcgtaaacaggacgtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccg

SEQ ID NO: 946 - DNA, 1398 bp, Microbacterium sp.
  Phylum:  Actinobacteria; Class: Actinobacteria; Order: Actinomycetales; Family: Microbacteriaceae
cacatgcagtcgaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaagcttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtcga

SEQ ID NO: 947 - DNA, 1397 bp, Microbacterium sp.
  Phylum:  Actinobacteria; Class: Actinobacteria; Order: Actinomycetales; Family: Microbacteriaceae
catgcagtcgaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcgatggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtcgaa

SEQ ID NO: 948 - DNA, 1396 bp, Microbacterium sp.
  Phylum:  Actinobacteria; Class: Actinobacteria; Order: Actinomycetales; Family: Microbacteriaceae
catgcagtcgaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtcga

SEQ ID NO: 949 - DNA, 1397 bp, Microbacterium  chocolatum
  Phylum:  Actinobacteria; Class: Actinobacteria; Order: Actinomycetales; Family: Microbacteriaceae
ccatgcaagtcgaacgatgaagcggtgcttgcaccgtggattagtggcgaacgggtgagtaacacgtgagcaacctgccctggactctgggataagcgctggaaacggtgtctaatactggatatgagctctcatcgcatggtgggggttggaaagattttttggtctgggatgggctcgcggcctatcagcttgttggtgaggtaatggcttaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgtgagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggtctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacggtttccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatacaccagaacaccgtagaaatacgggactctttggacactggtgaacaggtggtgcatggttgtcgtcagctcgtgtcgtgagatgttgggttaagtcccgcaacgagcgcaaccctcgttctatgttgccagcacgttatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaa

SEQ ID NO: 950 - DNA, 1401 bp, Microbacterium sp.
  Phylum:  Actinobacteria; Class: Actinobacteria; Order: Actinomycetales; Family: Microbacteriaceae
ccatgcagtcgaacggtgaacacggagcttgctctgtgggatcagtggcgaacgggtgagtaacacgtgagcaacctgcccctgactctgggataagcgctggaaacggcgtctaatactggatatgtgacgtgatcgcatggtctgcgtctggaaagaatttcggttggggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgcaagcctgatgcagcaacgccgcgtgagggacgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatccggaggctcaacctccggcctgcagtgggtacgggcagactagagtgcggtaggggagattggaattcctggtgtagcggtggaatgcgcagatatcaggaggaacaccgatggcgaaggcagatctctggggccgtaactgacgctgaggagcgaaaggggtggggagcaaacaggcttagataccctggtagtccaccccgtaaacgttgggaactagttgtggggtccattccacggattccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagccgtcgaat

SEQ ID NO: 951 - DNA, 1422 bp, Xanthomonas oryzae
  Phylum:  Proteobacteria; Class: Gammaproteobacteria; Order: Xanthomonadales; Family: Xanthomonadaceae
accatgcagtcgaacggcagcacaggagagcttgctctctgggtggcgagtggcggacgggtgaggaatacatcggaatctaccttttcgtgggggataacgtagggaaacttacgctaataccgcatacgaccttagggtgaaagcggaggaccttcgggcttcgcgcggatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgccagcagccgcggtaatacgaagggtgcaagcgttactcggaattactgggcgtaaagcgtgcgtaggtggttgtttaagtccgttgtgaaagccctgggctcaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaaacaggattagataccctggtagtccacgccctaaacgatgcgaactggatgttgggtgcaacttggcacgcagtatcgaagctaacgcgttaagttcgccgcctggggagtacggtcgcaagactgaaactcaaaggaattgacgggggcccgcacaagcggtggagtatggtaggtttaattcgatgcaacgcgttctaccttacctggtcttgacatccacggaaccttgcagagatggattggtgcctttcggtagcgtgagacacgtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacgaccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgccacg

SEQ ID NO: 952 - DNA, 1422 bp, Xanthomonas oryzae
  Phylum:  Proteobacteria; Class: Gammaproteobacteria; Order: Xanthomonadales; Family: Xanthomonadaceae
acacatgcagtcgaacggcagcacaggagagcttgctctctgggtggcgagtggcggacgggtgaggaatacatcggaatctaccttttcgtgggggataacgtagggaaacttacgctaataccgcatacgaccttagggtgaaagcggaggaccttcgggcttcgcgcggatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgccagcagccgcggtaatacgaagggtgcaagcgctactcggaattactgggcgtaaagcgtgcgtaggtggttgtttaagtccgttgtgaaagccctgggctcaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaaacaggattagataccctggtagtccacgccctaaacgatgcgaactggatgttgggtgcaacttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggtcttgacatccacggaacattgcagagatggattggtgccttcgggaaccgtgagacaggtgctgcatggctgtcgtcagctcgtgtcctgtcatgttcggttaagtcccgcaacgagcgcaacccttgtccttagttgccagcacgtaatggtgggaactctaaggagaccgccggtgacaaaccggaggaaggtggggatgacgtcaagtcatcatggcccttacgaccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgccacgg

SEQ ID NO: 953 - DNA, 1422 bp, Xanthomonas sp.
  Phylum:  Proteobacteria; Class: Gammaproteobacteria; Order: Xanthomonadales; Family: Xanthomonadaceae
acatgcaagtcgaacggcagcacaggagagcttgctctctgggtggcgagtggcggacgggtgaggaatacatcggaatctaccttttcgtgggggataacgtagggaaacttacgctaataccgcatacgaccttagggtgaaagcggaggaccttcgggcttcgcgcggatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgccagcagccgcggtaatacgaagggtgcaagcgttactcggaattactgggcgtaaagcgtgcgtaggtggttgtttaagtccgttgtgaaagccctgggctcaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaaacaggattagataccctggtagtccacgccctaaacgatgcgaactggatgttgggtgcaacttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggtcttgacatccacggaactttccagagatggattggtgccttcgggaaccgtgagacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacgaccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgccacggt

SEQ ID NO: 954 - DNA, 1418 bp, Xanthomonas sp.
  Phylum:  Proteobacteria; Class: Gammaproteobacteria; Order: Xanthomonadales; Family: Xanthomonadaceae
ccatgcagtcgaacggcagcacaggagagcttgctctctgggtggcgagtggcggacgggtgaggaatacatcggaatctaccttttcgtgggggataacgtagggaaacttacgctaataccgcatacgaccttagggtgaaagcggaggaccttcgggcttcgcgcggatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgccagcagccgcggtaatacgaagggtgcaagcgttactcggaattactgggcgtaaagcgtgcgtaggtggttgtttaagtccgttgtgaaagccctgggctcaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaaacaggattagataccctggtagtccacgccctaaacgatgcgaactggatgttgggtgcaacttggcacgcagtatcgaagctaacgcgttaagttcgccgcctggggagtacggtcgcaagactgaaactcaaaggaattgacgggggcccgcacaagcggtggagtatgtggtttaattcgatgcaacgcgaagaaccttacctggtcttgacatccacggaactttccagagatggattggtgccttcgggaaccgtgagacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacgaccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgccac

SEQ ID NO: 955 - DNA, 1426 bp, Xanthomonas sp.
  Phylum:  Proteobacteria; Class: Gammaproteobacteria; Order: Xanthomonadales; Family: Xanthomonadaceae
taccatgcagtcgaacggcagcacaggagagcttgctctctgggtggcgagtggcggacgggtgaggaatacatcggaatctaccttttcgtgggggataacgtagggaaacttacgctaataccgcatacgaccttagggtgaaagcggaggaccttcgggcttcgcgcggatagatgagccgatgtcggattagctagttggcggggtaaaggcccaccaaggcgacgatccgtagctggtctgagaggatgatcagccacactggaactgagacacggtccagactcctacgggaggcagcagtggggaatattggacaatgggcgcaagcctgatccagccatgccgcgtgggtgaagaaggccttcgggttgtaaagcccttttgttgggaaagaaaagcagtcggttaatacccgattgttctgacggtacccaaagaataagcaccggctaacttcgtgcccagcagccgcggtaatacgaagggtgcaagcgttactcggaattactgggcgtaaagcgtgcgtaggtggttgtttaagtccgttgtgaaagccctgggctcaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaaacaggattagataccctggtagtccacgccctaaacgatgcgaactggatgttgggtgcaacttggcacgcagtatcgaagctaacgcgttaagttcgccgcctggggagtacggtcgcaagactgaaactcaaaggaattgacgggggcccgcacaagcggtggagtatgtgggtttaattcgatgcaacgcgaagaacccttacctgggtcttgacatccacggaactttccagagatggattggtgccttcgggaaccgtgagacaggtgctgcatggctgtcgtcagctcgtgtcgtgagatgttgggttaagtcccgcaacgagcgcaacccttgtccttagttgccagcacgtaatggtgggaactctaaggagaccgccggtgacaaaccggaggaaggtggggatgacgtcaagtcatcatggcccttacgaccagggctacacacgtactacaatggtagggacagagggctgcaagccggcgacggtaagccaatcccagaaaccctatctcagtccggattggagtctgcaactcgactccatgaagtcggaatcgctagtaatcgcagatcagcattgctgcggtgaatacgttcccgggccttgtacacaccgcccgtcacaccatgggagtttgttgcaccagaagcaggtagcttaaccttcgggagggcgctgccacgg

SEQ ID NO: 956 - DNA, 1369 bp, Rhodococcus sp.
  Phylum:  Actinobacteria; Class: Actinobacteria; Order: Actinomycetales; Family: Nocardiaceae
agacagtcgagcggtaaggcctttacggggtacacgagcggcgaacgggtgagtaacacgtgggtgatctgccctgcacttcgggataagcctgggaaactgggtctaataccggatatgacctcctatcgcatggtgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtccggaattactgggcgtaaagagttcgtaggcggtttgtcgcgtcgtttgtgaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagtccacgccgtaaacggtgggcgctaggtgtgggttccttccacggaatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggtcttaacc

SEQ ID NO: 957 - DNA, 1341 bp, Rhodococcus sp.
  Phylum:  Actinobacteria; Class: Actinobacteria; Order: Actinomycetales; Family: Nocardiaceae
ttacggggtacacgagcggcgaacgggtgagtaacacgtgggtgatctgccctgcacttcgggataagcctgggaaactgggtctaataccggatatgacctcctatcgcatggtgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtccggaattactgggcgtaaagagttcgtaggcggtttgtcgcgtcgtttgtgaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagtccacgccgtaaacggtgggcgctaggtgtgggttccttccacggaatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggtc

SEQ ID NO: 958 - DNA, 1386 bp, Rhodococcus sp.
  Phylum:  Actinobacteria; Class: Actinobacteria; Order: Actinomycetales; Family: Nocardiaceae
tagcagtcgagcggtaaggcctttcggggtacacgagcggcgaacgggtgagtaacacgtgggtgatctgccctgcacttcgggataagcctgggaaactgggtctaataccggatatgacctcctatcgcatggtgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtccggaattactgggcgtaaagagttcgtaggcggtttgtcgcgtcgtttgtgaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagttcacgccgtaaacggtgggcgctaggtgtgggttccttccacggaatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcttaaccccttgtgggagggagccta

SEQ ID NO: 959 - DNA, 1387 bp, Rhodococcus sp.
  Phylum:  Actinobacteria; Class: Actinobacteria; Order: Actinomycetales; Family: Nocardiaceae
atgcagtcgagcggtaaggcctttcggggtacacgagcggcgaacgggtgagtaacacgtgggtgatctgccctgcacttcgggataagcctgggaaactgggtctaataccggatatgacctcctatcgcatggtgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtccggaattactgggcgtaaagagttcgtaggcggtttgtcgcgtcgtttgtgaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagtccacgccgtaaacggtgggcgctaggtgtgggttccttccacggaatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcttaaccccttgtgggagggagcctac

SEQ ID NO: 960 - DNA, 1393 bp, Rhodococcus sp.
  Phylum:  Actinobacteria; Class: Actinobacteria; Order: Actinomycetales; Family: Nocardiaceae
cacatgcagtcgagcggtaaggcctttcggggtacacgagcggcgaacgggtgagtaacacgtgggtgatctgccctgcacttcgggataagcctgggaaactgggtctaataccggatatgacctcctatcgcatggtgggtggtggaaagatttatcggtgcaggatgggcccgcggcctatcagcttgttggtggggtaatggcctaccaaggcgacgacgggtagccgacctgagagggtgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggacgaagcgcaagtgacggtacctgcagaagaagcaccggctaactacgtgccagcagccgcggtaatacgtagggtgcaagcgttgtccggaattactgggcgtaaagagttcgtaggcggtttgtcgcgtcgtttgtgaaaaccagcagctcaactgctggcttgcaggcgatacgggcagacttgagtactgcaggggagactggaattcctggtgtagcggtgaaatgcgcagatatcaggaggaacaccggtggcgaaggcgggtctctgggcagtaactgacgctgaggaacgaaagcgtgggtagcgaacaggattagataccctggtagtccacgccgtaaacggtgggcgctaggtgtgggttccttccacggaatccgtgccgtagctaacgcattaagcgccccgcctggggagtacggccgcaaggctaaaactcaaaggaattgacgggggcccgcacaagcggcggagcatgtggattaattcgatgcaacgcgaagaaccttacctgggtttgacatataccggaaagctgcagagatgtggccccccttgtggtcggtatacaggtggtgcatggctgtcgtcagctcgtgtcgtgagatgttgggttaagtcccgcaacgagcgcaacccctatcttatgttgccagcacgttatggtggggactcgtaagagactgccggggtcaactcggaggaaggtggggacgacgtcaagtcatcatgccccttatgtccagggcttcacacatgctacaatggccagtacagagggctgcgagaccgtgaggtggagcgaatcccttaaagctggtctcagttcggatcggggtctgcaactcgaccccgtgaagtcggagtcgctagtaatcgcagatcagcaacgctgcggtgaatacgttcccgggccttgtacacaccgcccgtcacgtcatgaaagtcggtaacacccgaagccggtggcttaaccccttgtgggagggagccgtcgaa

SEQ ID NO: 961 - DNA, 1430 bp, Paenibacillus sp.
  Phylum:  Firmicutes; Class: Bacilli; Order: Bacillales; Family: Paenibacillaceae
agtcgagcggagtcttggttggaagcttgcttccaacttggcttagcggcggacgggtgagtaacacgtaggcaacctgcccctaagactgggataactaccggaaacggtagctaataccggataatctctttcctctcctgagggaagaatgaaaggcggagcaatctgccacttggggatgggcctgcggcgcattagctagttggcggggtaacggcccaccaaggcgacgatgcgtagccgacctgagagggtgaacggccacactgggactgagacacggcccagactcctacgggaggcagcagtagggaatcttccgcaatgggcgacagcctgacggagcaacgccgcgtgagtgatgaaggttttcggatcgtaaagctctgttgccagggaagaacgtccggtagagtaactgttaccggagtgacggtacctgagaagaaagccccggctaactacgtgccagcagccgcggtaatacgtagggggcaagcgttgtccgggaattattgggcgtaaagcgcgcgcaggcggctatttaagtctggtgtttaaaccttgggctcaacctggggtcgcactggaaactgggtggcttgagtacagaagaggaaagtggaattccacgtgtagcggtgaaatgcgtagagatgtggaggaacaccagtggcgaaggcgactttctgggctgtaactgacgctgaggcgcgaaagcgtggggagcaaacaggattagataccctggtagtccacgccgtaaacgatgagtgctaggtgttaggggtttcgatacccttggtgccgaagttaacacagtaagcactccgcctggggagtacggtcgcaagactgaaactcaaaggaattgacggggacccgcacaagcagtggagtatgtggtttaattcgaagcaacgcgaagaacctttaccaggtcttgacatccaactaacgaagcagagatgcatcaggtgcccttcggggaaagttgagacaggtggtgcatggttgtcgtcagctcgtgtcgtgagatgttgggttaagtcccgcaacgagcgcaacccttgactttagttgccagcaggttgagctgggcactctagagtgactgccggtgacaaaccggaggaaggtggggatgacgtcaaatcatcatgccccttatgacctgggctacacacgtactacaatggccggtacaacgggaagcgaagccgcgaggtggagccaatcccagcaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttacaacacccgaagtcggtggggtaacccgcaagggagccagcctccg

SEQ ID NO: 962 - DNA, 1377 bp, Burkholderia phytofirmans caledonica
  Phylum:  Proteobacteria; Class: Betaproteobacteria; Order: Burkholderiales; Family: Burkholderiaceae
tagcaatcctggtggcgagtggcgaacgggtgagtaatacatcggaacgtgtcctgtagtgggggatagcccggcgaaagccggattaataccgcatacgatctgtggatgaaagcgggggatccttcgggacctcgcgctacaggggcggccgatggcagattagctagttggtggggtaaaggcctaccaaggcgacgatctgtagctggtctgagaggacgaccagccacactgggactgagacacggcccagactcctacgggaggcagcagtggggaattttggacaatgggcgaaagcctgatcccagcaatgccgcgtgtgtgaagaaggccttcgggttgtaaagcacttttgtccggaaagaaaacctcgtggttaatacccgtgggggatgacggtaccggaagaataagcaccggctaactacgtgccagcagccgcggtaatacgtagggtgcaagcgttaatcggaattactgggcgtaaagcgtgcgcaggcggtccgctaagacagatgtgaaatccccgggcttaacctgggaactgcatttgtgactggcgggctagagtatggcagaggggggtagaattccacgtgtagcagtgaaatgcgtagagatgtggaggaataccgatggcgaaggcagccccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatgtatggaacctggctgagaggtccgggtgcccgaaagggagccataacacagggtgctgcatggctgtcgtcagctcgtgtcgtgagatgttgggataagtcccgcaacgagcgcaacccttgtccctagttgctacgcaagagcactctagggagactgccggtgacaaaccggaggaaggtggggatgacgtcaagtcctcatggcccttatgggtagggcttcacacgtcatacaatggtcggaacagagggtcgccaacccgcgagggggagccaatcccagaaaaccgatcgtagtccggatcgcactctgcaactcgagtgcgtgaagctggaatcgctagtaatcgcggatcagcatgccgcggtgaatacgttcccgggtcttgtacacaccgcccgtcacaccatgggagtgggttttaccagaagtggctagtctaaccgcaaggaggacg

SEQ ID NO: 963 - DNA, 1432 bp, Staphylococcus dispersa
  Phylum:  Firmicutes; Class: Bacilli; Order: Bacillales; Family: Staphylococcaceae
tatacatgcagtcgagcgaacagataaggagcttgctcctttgacgttagcggcggacgggtgagtaacacgtggataacctacctataagactgggataacttcgggaaaccggagctaataccggataacatattgaaccgcatggttcaatagtgaaaggcggctttgctgtcacttatagatggatccgcgccgtattagctagttggtaaggtaacggcttaccaaggcaacgatacgtagccgacctgagagggtgatcggccacactggaactgagacacggtccagactcctacgggaggcagcagtagggaatcttccgcaatgggcgaaagcctgacggagcaacgccgcgtgagtgatgaaggtcttcggatcgtaaaactctgttatcagggaagaacaaatgtgtaagtaactgtgcacatcttgacggtacctgatcagaaagccacggctaactacgtgccagcagccgcggtaatacgtaggtggcaagcgttatccggaattattggggcgtaaagcgcgcgtaggcggtttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcggaagaaccttaccaaatcttgacatcctttgaccgctctagagatagagtcttccccttcgggggacaaagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggcagctaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccggtggagtaaccatttatggagctagccgtcga

SEQ ID NO: 964 - DNA, 1422 bp, Bacillus altitudinis
  Phylum:  Firmicutes; Class: Bacilli; Order: Bacillales; Family: Bacillaceae
catgcaagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcaagagtaactgcttgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcgagaccgcaaggtttagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagcctccg

SEQ ID NO: 965 - DNA, 1432 bp, Bacillus altitudinis
  Phylum:  Firmicutes; Class: Bacilli; Order: Bacillales; Family: Bacillaceae
atacatgcagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcaagagtaactgcttgcaccttgaccggtacctaaccagaaaaggccacggctaactacgtgccagcagccgcggtaatacgtaggtggcaagcgttgtccggaattattgggcgtaaagggctcgcaggcggtttcttaagtctgatgtgaaagcccccggctcaacccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggattaattcgaagcaacgcgaagaagcttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcgagaccgcaaggtttagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccgaaggt

SEQ ID NO: 966 - DNA, 1429 bp, Bacillus sp.
  Phylum:  Firmicutes; Class: Bacilli; Order: Bacillales; Family: Bacillaceae
tatacatgcaagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtggggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcgagagtaactgctcgcaccttgacggtacctaaccagaaagccacggctaactacgtgccagcagccgcggtaatacgtaggtggcaagcgttgtcccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcaagaccgcaaggtttagccaatcccataaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccgaaa

SEQ ID NO: 967 - DNA, 1429 bp, Bacillus sp.
  Phylum:  Firmicutes; Class: Bacilli; Order: Bacillales; Family: Bacillaceae
tacatgcaagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtggggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtgggagcatgtgggtttaattcgaagcaacgcgaagaaccttaccaggtcttgacatcctctgacatccctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcaagaccgcaaggtttagccaatcccataaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccgatgg

SEQ ID NO: 968 - DNA, 1426 bp, Bacillus sp.
  Phylum:  Firmicutes; Class: Bacilli; Order: Bacillales; Family: Bacillaceae
tacatgcaagtcgagcgaacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtggggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggacagaacaaagggctgcgagaccgcaaggtttagccaatcccataaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccgatg

SEQ ID NO: 969 - DNA, 1429 bp, Bacillus sp.
  Phylum:  Firmicutes; Class: Bacilli; Order: Bacillales; Family: Bacillaceae
actacatgcaagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcaagagtaactgcttgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccagggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcgagaccgcaaggtttagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccgatg

SEQ ID NO: 970 - DNA, 1418 bp, Bacillus sp.
  Phylum:  Firmicutes; Class: Bacilli; Order: Bacillales; Family: Bacillaceae
catgcagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtggggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaacgctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcaagaccgcaaggtttagccaatcccataaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgc

SEQ ID NO: 971 - DNA, 1419 bp, Bacillus sp.
  Phylum:  Firmicutes; Class: Bacilli; Order: Bacillales; Family: Bacillaceae
ctacatgcagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtggggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcaagaccgcaaggtttagccaatcccataaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagcc

SEQ ID NO: 972 - DNA, 1423 bp, Bacillus sp.
  Phylum:  Firmicutes; Class: Bacilli; Order: Bacillales; Family: Bacillaceae
tacatgcagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcaagagtaactgcttgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcgagaccgcaaggtttagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccga

SEQ ID NO: 973 - DNA, 1419 bp, Bacillus sp.
  Phylum:  Firmicutes; Class: Bacilli; Order: Bacillales; Family: Bacillaceae
catgcagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtggggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagtagcttaccaggtcttgacatcctctgacatccctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcaagaccgcaaggtttagccaatcccataaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagcctct

SEQ ID NO: 974 - DNA, 1422 bp, Bacillus sp.
  Phylum:  Firmicutes; Class: Bacilli; Order: Bacillales; Family: Bacillaceae
aatacatgcagtcgagcggacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcaagagtaactgcttgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggatttgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggctgcgagaccgcaaggtttagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagcctc

SEQ ID NO: 975 - DNA, 1428 bp, Bacillus subtilis
  Phylum:  Firmicutes; Class: Bacilli; Order: Bacillales; Family: Bacillaceae
tgctatacatgcagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagtagcttaccaggtcttgacatcctctgacaatcctagagataggacgtccccttcgggggcagagtgacaggtcgtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccg

SEQ ID NO: 976 - DNA, 1407 bp, Bacillus hydrocarbonoxydans
  Phylum:  Firmicutes; Class: Bacilli; Order: Bacillales; Family: Bacillaceae
agcagtcgagcggacagatgggtagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtcgtgcatggttgtcgtcagctcgtgtcgtgagatgttgggttaagtcccgcaacgagcgcatcccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttag

SEQ ID NO: 977 - DNA, 1428 bp, Bacillus sp.
  Phylum:  Firmicutes; Class: Bacilli; Order: Bacillales; Family: Bacillaceae
acatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaacccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaaggtcttgacatcctctgacaatcctagagataggacgtccccttcgggggcagagtgacaggaggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaag

SEQ ID NO: 978 - DNA, 1428 bp, Bacillus sp.
  Phylum:  Firmicutes; Class: Bacilli; Order: Bacillales; Family: Bacillaceae
ctatacatgcagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccgggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataaggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccg

SEQ ID NO: 979 - DNA, 1429 bp, Bacillus sp.
  Phylum:  Firmicutes; Class: Bacilli; Order: Bacillales; Family: Bacillaceae
atacatgcaagtcgagcggacagatgggagcttgctccctgatgttagcggcggacgggtgagtaacacgtgggtaacctgcctgtaagactgggataactccgggaaaccggggctaataccggatgcttgtttgaaccgcatggttcaaacataaaaggtggcttcggctaccacttacagatggacccgcggcgcattagctagttggtgaggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtgggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaag

SEQ ID NO: 980 - DNA, 1428 bp, Bacillus sp.
  Phylum:  Firmicutes; Class: Bacilli; Order: Bacillales; Family: Bacillaceae
tatacatgcagtcgagcggacagatgggagcttgctccctgatgttagcggcggacgggtgagtaacacgtgggtaacctgcctgtaagactgggataactccgggaaaccggggctaataccggatggttgtctgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaag

SEQ ID NO: 981 - DNA, 1426 bp, Bacillus sp.
  Phylum:  Firmicutes; Class: Bacilli; Order: Bacillales; Family: Bacillaceae
catgcaagtcgagcggacagatgggagcttgctccctgatgttagcggcggacgggtgagtaacacgtgggtaacctgcctgtaagactgggataactccgggaaaccggggctaataccggatggttgtctgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaatg

SEQ ID NO: 982 - DNA, 1348 bp, Sphingomonas sanguinis
  Phylum:  Proteobacteria; Class: Alphaproteobacteria; Order: Sphingomonadales; Family: Sphingomonadaceae
aacgaaggcttcggccttagtggcgcacgggtgcgtaacgcgtgggaatctgccctttggttcggaataacagctggaaacggctgctaataccggatgatgacgaaagtccaaagatttatcgccagaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgatttccagagatggatctcttcccttcggggactggaacacaggtgctgcatggctgtcgtcagctcgtgtcgtgagatgttgggttaagtcccgcaacgagcgcaaccctcgcctttagttaccatcatttagttgggtactctaaaggaaccgccggtgataagccggaggaaggtggggatgacgtcaagtcctcatggcccttacgcgctgggctacacacgtgctacaatggcaactacagtgggcagcgaccctgcgagggcgagctaatccccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccgcaagggaagcaggcgtac

SEQ ID NO: 983 - DNA, 1367 bp, Sphingomonas sanguinis
  Phylum:  Proteobacteria; Class: Alphaproteobacteria; Order: Sphingomonadales; Family: Sphingomonadaceae
acatgcagtcgaacgaaggcttcggccttagtggcgcacgggtgcgtaacgcgtgggaatctgcccttaggttcggaataacagctggaaacggctgctaataccggatgatatcgcgagatcaaagatttatcgcctgaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgcaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgccctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgatttccagagatggattttcttcccttcggggactgggaacacaggtgctgcatggctgtcgtcagctcgtgtcgtgagatgttgggttaagtcccgcaacgagcgcaaccctcgcctttagttaccatcatttggttgggtactctaaaggaaccgccggtgataagccggaggaaggtggggatgacgtcaagtcctcatggcccttacgcgctgggctacacacgtgctacaatggcaactacagtgggcagcgaccctgcgagggcgagctaatccccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccgcaagggaagcaggcgaccacggt

SEQ ID NO: 984 - DNA, 1333 bp, Sphingomonas sanguinis
  Phylum:  Proteobacteria; Class: Alphaproteobacteria; Order: Sphingomonadales; Family: Sphingomonadaceae
gagagccttcggagtttagtggcgcacgggtgcgtaacgcgtgggaatctgccctttggttcggaataacagctggaaacggctgctaataccggatgatgacgaaagtccaaagatttatcgccagaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgctttgggtggcgcagctaacgcacttaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgatttccagagatggatctcttcccttcggggactggaacacaggtgctgcatggctgtcgtcagctcgtgtcgtgagatgttgggttaagtcccgcaacgagcgcaaccctcgcctttagttaccatcatttggttgggtactctaaaggaaccgccggtgataagccggaggaaggtggggatgacgtcaagtcctcatggcccttacgcgctgggctacacacgtgctacaatggcaactacagtgggcagcgaccctgcgagggcgagctaatccccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgctgacgcagatc

SEQ ID NO: 985 - DNA, 1366 bp, Sphingomonas  yabuuchiae
  Phylum:  Proteobacteria; Class: Alphaproteobacteria; Order: Sphingomonadales; Family: Sphingomonadaceae
catgcaagtcgaacgaaggcttcggccttagtggcgcacgggtgcgtaacgcgtgggaatctgcccttaggttcggaataacagctggaaacggctgctaataccggatgatgacgaaagtccaaagatttatcgcctgaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagcccccggctaactccgtgccagcagccgcggtaatacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgatttccagagatggatctcttcccttcggggactggaaacacaggtgctgcatggctgtcgtcagctcgtgtcgtgagatgttggggttaagtccccgaacgagcgcaaccctcgcctttagttaccatcattgagttgggtactctaaaggaaccgccggtgataagccggaggaaggtggggatgacgtcaagtcctcatggcccttacgcgctgggctacacacgtgctacaatggcaactacagtgggcagcgaccctgcgagggcgagctaatccccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccgcaagggaagcaggcgaccacgg

SEQ ID NO: 986 - DNA, 1366 bp, Sphingomonas  yabuuchiae
  Phylum:  Proteobacteria; Class: Alphaproteobacteria; Order: Sphingomonadales; Family: Sphingomonadaceae
accatgcagtcgaacgaaggcttcggccttagtggcgcacgggtgcgtaacgcgtgggaatctgcccttaggttcggaataacagctggaaacggctgctaataccggatgatgacgaaagtccaaagatttatcgcctgaggatgagcccgcgttggattaggtagttggtggggtaaaggcctaccaagccgacgatccatagctggtctgagaggatgatcagccacactgggactgagacacggcccagactcctacgggaggcagcagtggggaatattggacaatgggcgaaagcctgatccagcaatgccgcgtgagtgatgaaggccctagggttgtaaagctcttttacccgggaagataatgactgtaccgggagaataagccccggtctaactccgtgccagcagccgcggtaatacggagggggctagcgttgttcggaattactgggcgtaaagcgcacgtaggcggctttgtaagtcagaggtgaaagccctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacaggattagataccctggtagtccacgccgtaaacgatgataactagctgtccgggcacttggtgcttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgatttccagagatggatctcttcccttcggggactggtacacaggtgctgcatggctgtcgtcagctcgtgtcgtgagatgttgggttaagtcccgcaacgagcgcaaccctcgcctttagttaccatcattgagttgggtactctaaaggaaccgccggtgataagccggaggaaggtggggatgacgtcaagtcctcatggcccttacgcgctgggctacacacgtgctacaatggcaactacagtgggcagcgaccctgcgagggcgagctaatccccaaaagttgtctcagttcggattgttctctgcaactcgagagcatgaaggcggaatcgctagtaatcgcggatcagcatgccgcggtgaatacgttcccaggccttgtacacaccgcccgtcacaccatgggagttggattcacccgaaggcgttgcgccaacccgcaagggaagcaggcgaccacgg

SEQ ID NO: 987 - DNA, 1378 bp, Sphingobium sp.
  Phylum:  Proteobacteria; Class: Alphaproteobacteria; Order: Sphingomonadales; Family: Sphingomonadaceae
cagtctatacatgcaagtcgaacgagatcttcggatctagtggcgcacgggtgcgtaacgcgtgggaatctgcccttgggttcggaataacttctggaaacggaagctaataccggatgatgacgtaagtccaaagatttatcgcccaaggatgagcccgcgtaggattagctagttggtggggtaaaggcccaccaaggcgacgatccttagctggtctgagaggatgatcagccacactgggactgagacacggcccagactcctacgggaggcagcagtagggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttgttcggaattactgggcgtaaagcgcacgtaggcggctattcaagtcagaggtgaaagcccggggctcaaccccggaactgcctttgaaactagatagcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtcagggcacatggtgttttggtggcgcagctaacgcattaagttatccgcctggggagtacggtcgcaagattaaaactcaaaggaattgacgggggcctgcacaagcggtggagcatgtggtttaattcgaagcaacgcgcagaaccttaccaacgtttgacatccctatcgcggatcgtgggagacactttccttcagttcggctggataggtgacaggtgctgcatggctgtcgtcagctcgtgtcgtgagatgttggggttaagtcccgcaacgagcgcaaccctcgcctttagttgccagcatttagttgggtactctaaaggaaccgccggtgataagccggaggaaggtggggatgacgtcaagtcctcatggcccttacgcgttgggctacacacgtgctacaatggcgactacagtgggcagccacctcgcgagagggagctaatctccaaaagtcgtctcagttcggatcgttctctgcaactcgagagcgtgaaggcggaatcgctagtaatcgcggatcagcatgccgcggtgaatacgttcccaggccttgtacacaccgcccgtcacaccatgggagttggattcactcgaaggcgttgagctaaccgtaaggaggcaggcgaccacagtgta

SEQ ID NO: 988 - DNA, 1400 bp, Herbaspirillum sp.
  Phylum:  Proteobacteria; Class: Betaproteobacteria; Order: Burkholderiales; Family: Oxalobacteraceae
agacagtcgaacggcagcataggagcttgctcctgatggcgagtggcgaacgggtgagtaatatatcggaacgtgccctagagtgggggataactagtcgaaagactagctaataccgcatacgatctacggatgaaagtgggggatcgcaagacctcatgctcctggagcggccgatatctgattagctagttggtggggtaaaagcctaccaaggcaacgatcagtagctggtctgagaggacgaccagccacactgggactgagacacggcccagactcctacgggaggcagcagtggggaattttggacaatgggggcaaccctgatccagcaatgccgcgtgagtgaagaaggccttcgggttgtaaagctcttttgtcagggaagaaacggtagtagctaatatctattactaatgacggtacctgaagaataagcaccggctaactacgtgccagcagccgcggtaatacgtagggtgcaagcgttaatcggaattactgggcgtaaagcgtgcgcaggcggttgtgtaagtcagatgtgaaatccccgggctcaaccctgggaattgcatttgagactgcacggctagagtgtgtcagaggggggtagaattccacgtgtagcagtgaaatgcgtagatatgtggaggaataccgatggcgaaggcagccccctgggataacactgacgctcatgcacgaaagcgtggggagcaaacaggattagataccctggtagtccacgccctaaacgatgtctactagttgtcgggtcttaattgacttggtaacgcagctaacgcgtgaagtagaccgcctggggagtacggtcgcaagattaaaactcaaaggaattgacggggacccgcacaagcggtggatgatgtggattaattcgatgcaacgcgaaaaaccttacctacccttgacatggatggaatcccgaagagatttgggagtgctcgaaagagaaccatcacacaggtgctgcatggctgtcgtcagctcgtgtcgtgagatgttgggttaagtcccgcaacgagcgcaacccttgtcattagttgctacgaaagggcactctaatgagactgccggtgacaaaccggaggaaggtggggatgacgtcaagtcctcatggcccttatgggtagggcttcacacgtcatacaatggtacatacagagggccgccaacccgcgagggggagctaatcccagaaagtgtatcgtagtccggattggagtctgcaactcgactccatgaagttggaatcgctagtaatcgcggatcagcatgtcgcggtgaatacgttcccgggtcttgtacacaccgcccgtcacaccatgggagcgggttttaccagaagtgggtagcctaaccgcaaggagggcgta

SEQ ID NO: 989 - DNA, 1393 bp, Paenibacillus  amylolyticus
  Phylum:  Firmicutes; Class: Bacilli; Order: Bacillales; Family: Paenibacillaceae
acttgaagagaagcttgcttctctgatggttagcggcggacgggtgagtaacacgtaggcaacctgccctcaagcttgggacaactaccggaaacggtagctaataccgaatacttgttttcttcgcctgaagagaactggaaagacggagcaatctgtcacttggggatgggcctgcggcgcattagctagttggtgaggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatgtaagtctggtgtttaatcccggggctcaaccccggatcgcactggaaactgcgtgacttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtggagtatgtggtttaattcgaagcaacgcgaagaaccttaccaggtcttgacatccaactaacgaggcagagatgcgttaggtgcccttcggggaaagttgagacaggtggtgcatggttgtcgtcagctcgtgtcgtgagatgttgggttaagtcccgcaacgagcgcaacccttatatttagttgccagcacttcgggtgggcactctagatagactgccggtgacaaaccggaggaaggtggggatgacgtcaaatcatcatgccccttatgacctgggctacacacgtactacaatggccggtacaacgggcagcgaaatcgcgagatggagccaatcccaacaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaac

SEQ ID NO: 990 - DNA, 1401 bp, Paenibacillus sp.
  Phylum:  Firmicutes; Class: Bacilli; Order: Bacillales; Family: Paenibacillaceae
gaagcttgcttccttgatacttagcaggcggacgggtgagtaacacgtaggcaacctgccctcaagcttgggacaactaccggaaacggtagctaataccgaatacttgttttcttcgcctgaagggaactggaaagacggagcaatctgtcacttgaggatgggcctgcggcgcattagctagttggtgaggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctcccaaggtgacggtacctgagaagaaagccccggctaactacgtgccagcagccgcggtaatacgtagggggcaagcgttgtccggaattattgggcgtaaagcgcgcgcaggcggtcatgtaagtctggtgtttaatcccggggctcaaccccggatcgcactggaaactgcgtgacttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccaactaacgaggtagagatacgttaggtgcccttcggggaaagttgagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggcagtgaaaccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagcctc

SEQ ID NO: 991 - DNA, 1350 bp, Paenibacillus sp.
  Phylum:  Firmicutes; Class: Bacilli; Order: Bacillales; Family: Paenibacillaceae
gtaggcaacctgccctcaagcttgggacaactaccggaaacggtagctaataccgaatacttgttttcttcgcctgaagggaactggaaagacggagcaatctgtcacttgaggatgggcctgcggcgcattagctagttggggaggtaacggctcaccaaggcgacgatgcgtagccgacctgagagggtgatcggccacactgggactgaaacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctcccaaggtgacggtacctgagaagaaagccccggctaactacgtgccagcagccgcggtaatacgtagggggcaagcgttgtccggaattattgggcgtaaagcgcgcgcaggcggtcatgtaagtctggtgtttaatcccggggctcaaccccggatcgcactggaaactgcgtgacttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccaggtcttgacatccaactaacgaggcagagatgcgttaggtgcccttcggggaaagttgagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggcagtgaagccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagcca

SEQ ID NO: 992 - DNA, 1418 bp, Paenibacillus sp.
  Phylum:  Firmicutes; Class: Bacilli; Order: Bacillales; Family: Paenibacillaceae
agcagtcgagcggagttgatgggaaagcttgcttccctgagacttagcggcggacgggtgagtaacacgtaggcaacctgccctcaagcttgggacaactaccggaaacggtagctaataccgaatacttgttttcttcgcctgaagggaactggaaagacggagcaatctgtcacttgaggatgggcctgcggcgcattagctagttggtgaggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctcccaaggtgacggtacctgagaagaaagccccggctaactacgtgccagcagccgcggtaatacgtagggggcaagcgttgtccggaattattgggcgtaaagcgcgcgcaggcggtcatgtaagtctggtgtttaatcccggggctcaaccccggatcgcactggaaactgcgtgacttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgaatgctaggtgttaggggtttcgatacccttggtgccgaagttaacacattaagcattccgcctggggagtacggtcgcaagactgaaactcaaaggaattgacggggacccgcacaagcagtggagtatgtggtttaattcgaagcaacgcgaagaaccttaccagggtcttgacatccaactaacgaggtagagatacgttaggtgcccttcggggaaagttgagacaggtggtgcatggttgtcgtcagctcgtgtcgtgagatgttgggttaagtcccgcaacgagcgcaacccttgatcttagttgccagcacttcgggtgggcactctaaggtgactgccggtgacaaaccggaggaaggtggggatgacgtcaaatcatcatgccccttatgacctgggctacacacgtactacaatggccggtacaacgggcagtgaaaccgcgaggtggaacgaatcctaaaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaactgcaaggagcc

SEQ ID NO: 993 - DNA, 1412 bp, Paenibacillus  amylolyticus
  Phylum:  Firmicutes; Class: Bacilli; Order: Bacillales; Family: Paenibacillaceae
gcaagagaagcttgcttctctgatgcgttagcggcggacgggtgagtaacacgtaggcaacctgccctcaagcttgggacaactaccggaaacggtagctaataccgaatacttgttttcttcgcctgaagagaactggaaagacggagcaatctgtcacttggggatgggcctgcggcgcattagctagttggtgaggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccgggaattattgggcgtaaagcgcgcgcaggcggtcatgtaagtctggtgtttaatcccggggctcaaccccggatcgcactggaaactgtgtgacttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacgcgcacaagcagtggagtatgtggtttaattcgaagcaacgcgaagaaccttaccagggtcttgacatccaactaacgaggcagagatgcatcaggtgcccttcggggaaagttgagacaggtggtgcatggttgtcgtcagctcgtgtcgtgagatgttgggttaagtcccgcaacgagcgcaacccttatatttagttgccagcatttcggatgggcactctagatagactgccggtgacaaaccggaggaaggtggggatgacgtcaaatcatcatgccccttatgacctgggctacacacgtactacaatggccggtacaacgggctgcgaaatcgcgagatggagccaatcccaacaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaaccgcaaggagccagcctccg

SEQ ID NO: 994 - DNA, 1393 bp, Paenibacillus   amylolyticus
  Phylum:  Firmicutes; Class: Bacilli; Order: Bacillales; Family: Paenibacillaceae
cttgaagagaagcttgcttctctgatggttagcggcggacgggtgagtaacacgtaggcaacctgccctcaagcttgggacaactaccggaaacggtagctaataccgaatacttgttttcttcgcctgaagagaactggaaagacggagcaatctgtcacttggggatgggcctgcggcgcattagctagttggtgaggtaacggctcaccaaggcgacgatgcgtagccgacctgagagggtgatcggccacactgggactgagacacggcccagactcctacgggaggcagcagtagggaatcttccgcaatgggcgaaagcctgacggagcaatgccgcgtgagtgatgaaggttttcggatcgtaaagctctgttgccagggaagaacgcttgggagagtaactgctctcaaggtgacggtacctgagaagaaagccccggctaactacgtgccagcagccgcggtaatacgtagggggcaagcgttgtccggaattattgggcgtaaagcgcgcgcaggcggtcatgtaagtctggtgtttaatcccggggctcaaccccggatcgcactggaaactgtgtgacttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacaggattagataccctggtagtccacgccgtaaacgatgagtgctaggtgttaggggtttcgatacccttggtgccgaagttaacacattaagcactccgcctggggagtacggtcgcaagactgaaactcaaaggaattgacggggacccgcacaagcagtgcagtatgtggtttaattcgaagcaacgcgaagaaccttaccaggtcttgacatccaactaacgaggcagagatgcatcaggtgcccttcggggaaagttgagacaggtggtgcatggttgtcgtcagctcgtgtcgtgagatgttgggttaagtcccgcaacgagcgcaacccttatatttagttgccagcacttcggatgggcactctagatagactgccggtgacaaaccggaggaaggtggggatgacgtcaaatcatcatgccccttatgacctgggctacacacgtactacaatggccggtacaacgggctgcgaaatcgcgagatggagccaatcccaacaaagccggtctcagttcggattgcaggctgcaactcgcctgcatgaagtcggaattgctagtaatcgcggatcagcatgccgcggtgaatacgttcccgggtcttgtacacaccgcccgtcacaccacgagagtttataacacccgaagtcggtggggtaact

SEQ ID NO: 995 - DNA, 1381 bp, Microbacterium binotii
  Phylum:  Actinobacteria; Class: Actinobacteria; Order: Actinomycetales; Family: Microbacteriaceae
gaacggtgaagcagagcttgctctgtggatcagtggcgaacgggtgagtaacacgtgagcaacctgccctggactctgggataagcgctggaaacggcgtctaatactggatacgagacgtggccgcatggtcaacgtttggaaagattttttggttcaggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagcaaggaagaagcgaaagtgacggtacttgcagaaaaagcgccggctaactacgtgccagcagccgcggtaatacgtagggcgcaagcgttatccggaattattgggcgtaaagagctcgtaggcggtttgtcgcgtctgctgtgaaaactggaggctcaacctccagcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacggtttccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgctgcagaaatgtagaactctttggacactcgtatacaggtcgacgcacgatgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcctaacccttgtggagggagcc

SEQ ID NO: 996 - DNA, 1421 bp, Enterobacter cloacae
  Phylum:  Proteobacteria; Class: Gammaproteobacteria; Order: Enterobacteriales; Family: Enterobacteriaceae
acatgcagtcgagcggtagcacaggagagcttgctctccgggtgacgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgaggttaataacctcgtcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcacgtgcgaaagcgtggggagcaaacaggattagataccctggtagtccacgccgtatacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatggtggtttaattcgatgcaacgcgaagaaccttacctactcttgacatccagagaactttgcagagatgcattggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccactttga

SEQ ID NO: 997 - DNA, 1422 bp, Enterobacter  cloacae
  Phylum:  Proteobacteria; Class: Gammaproteobacteria; Order: Enterobacteriales; Family: Enterobacteriaceae
taccatgcagtcgagcggtagcacaggagagcttgctctccgggtgacgagcggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgaggttaataacctcgtcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtaccgccgcaaggttaaaactcaaatgaattgacgggggcccgcacaagcggtggagcatgtggtttaattcgatgcaacgcgaagtaccttacctactcttgacatccagagtacttttcagagatgcattggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccactttga

SEQ ID NO: 998 - DNA, 1415 bp, Enterobacter sp.
  Phylum:  Proteobacteria; Class: Gammaproteobacteria; Order: Enterobacteriales; Family: Enterobacteriaceae
accatgcagtcgacggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccgcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatggtttggtgccttcgggaactctgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgagtagggctacacacgtgctacaatggcgcatacaaagagaagcgaactcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgctaccatat

SEQ ID NO: 999 - DNA, 1379 bp, Micrococcus paraconglomeratum
  Phylum:  Actinobacteria; Class: Actinobacteria; Order: Actinomycetales; Family: Micrococcaceae
tgcaagtcgaacgatgaagcccagcttgctgggtggattagtggcgaacgggtgagtaacacgtgagtaacctgcccttaactctgggataagcctgggaaactgggtctaataccggataggagcgcccaccgcatggtgggtgttggaaagatttatcggttttggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgaaagtgacggtacctgcagaagaagcaccggctaactacgtgccagcagccgcggtaatacgtagggtgcgagcgttatccggaattattgggcgtaaagagctcgtaggcggtttgtcgcgtctgtcgtgaaagtccggggcttaaccccggatctgcggtgggtacgggcagactagagtgcagtaggggagactggaattcctggtgtagcggtggaatgcgcagatatcaggaggaacaccgatggcgaaggcaggtctctgggctgtaactgacgctgaggagcgaaagcatggggagcgaacaggattagataccctggtagtccatgccgtaaacgttgggcactaggtgtggggaccattccacggtttccgcgccgcagctaacgcattaagtgccccgcctggggagtacggccgcaaggctaaaactcaaaggaattgacggggggcccgcacaagcggcggagcatgcggattaatttgatgcaacgcgaagaaccttaccaaggcttgacatgttcctcgatcgctgtacagatacggtttcccctttgggacgggttcacaggtggtgcatggttgtagtcagctcgtgtcgtgagatgtagggttaagtcccgcaacgagcgcaaccctcgttccatgttgccagcacgtcgtggtggggaatcatgggaggctgccggggtcaactaggaggaaggtgaggacgacgtcaaatcatcatgccccttatgtcttgggcttcacgcatgctacaatggccggtacaatgggttgcgatactgtgaggtggagctaatcccaaaaagccggtctcagttcggatgggggtgtgcaactcgaccccatgaagtcggagtcgctagtaatcgcagatcagcaacgatgcggtgaatacgttcccgggccttgtacaccccgcccgtcaagtcacgaaagttggtaacacccgaagccggtggcctaaccctt

SEQ ID NO: 1000 - DNA, 1398 bp, Micrococcus luteus
  Phylum:  Actinobacteria; Class: Actinobacteria; Order: Actinomycetales; Family: Micrococcaceae
accatgcagtcgaacgatgaagcccagcttgctgggtggattagtggcgaacgggtgagtaacacgtgagtaacctgcccttaactctgggataagcctgggaaactgggtctaataccggataggagcgtccaccgcatggtgggtgttggaaagatttatcggttttggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgaaagtgacggtacctgcagaagaagcaccggctaactacgtgccagcagccgcggtaatacgtagggtgcgagcgttatccggaattattgggcgtaaagagctcgtaggcggtttgtcgcgtctgtcgtgaaagtccggggcttaaccccggatctgcggtgggtacgggcagactagagtgcagtaggggagactggaattccctggtgtagcggtggaatgcgcagatatcaggaggaacaccgatggcgaaggcaggtctctgggctgtaactgacgctgaggagcgaaagcatggggagcgaacaggattagataccctggtagtccatgccgtaaacgttgggcactaggtgtggggaccattccacggtttccgcgccgcagctaacgcattaagtgccccgcctggggagtacggccgcaaggctaaaactcaaaggaattgacgggggcccgcacaagcggcggagcatgcggattaattcgatgcaacgcgaagtagcttaccaaggcttgacatgttctcgatcgccgtagagatacggttttccctttggggcgggatcacaggatggtgcatggttgtcgtcagctcgtgtcgtgagatgttgggttaagtcccgcaacgagcgcaaccctcgttccatgttgccagcacgtaatggtggggactcatgggagactgccggggtcaactcggaggaaggtgaggacgacgtcaaatcatcatgccccttatgtcttgggcttcacgcatgctacaatggccggtacaatgggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttggtaacacccgaagccggtggcctaacccttgtggggggagccgtcg

SEQ ID NO: 1001 - DNA, 1396 bp, Micrococcus luteus
  Phylum:  Actinobacteria; Class: Actinobacteria; Order: Actinomycetales; Family: Micrococcaceae
ttgcagtcgaacgatgaagcccagcttgctgggtggattagtggcgaacgggtgagtaacacgtgagtaacctgcccttaactctgggataagcctgggaaactgggtctaataccggataggagcgtccaccgcatggtgggtgttggaaagatttatcggttttggatggactcgcggcctatcagcttgttggtgaggtaatggctcaccaaggcgacgacgggtagccggcctgagagggtgaccggccacactgggactgagacacggcccagactcctacgggaggcagcagtggggaatattgcacaatgggcgcaagcctgatgcagcgacgccgcgtgagggatgacggccttcgggttgtaaacctctttcagtagggaagaagcgaaagtgacggtacctgcagaagaagcaccggctaactacgtgccagcagccgcggtaatacgtagggtgcgagcgttatccggaattattgggcgtaaagagctcgtaggcggtttgtcgcgtctgtcgtgaaagtccggggcttaacccccggatctgcggtgggtacgggcagactagagtgcagtaggggagactggaattccctggtgtagcggtggaatgcgcagatatcaggaggaacaccgatggcgaaggcaggtctctgggctgtaactgacgctgaggagcgaaagcatggggagcgaacaggattagataccctggtagtccatgccgtaaacgttgggcactaggtgtggggaccattccacggtttccgcgccgcagctaacgcattaagtgccccgcctggggagtacggccgcaaggctaaaactcaaaggaattgacgggggcccgcacaagcggcggagcatgcggattaattcgatgcaacgcgaagaaccttaccaaggcttgacatgttctcgatcgccgtagagatacgggtttcccgtttggggcgggttcacaggacgatgtacgatgtcgtcagctcgtgtcgtgagatgttgggataagtcccgcaacgagcgcaaccctcgttccatgttgccagcacgtaatggtggggactcatgggagactgccggggtcaactcggaggaaggtgaggacgacgtcaaatcatcatgccccttatgtcttgggcttcacgcatgctacaatggccggtacaatgggttgcgatactgtgaggtggagctaatcccaaaaagccggtctcagttcggattggggtctgcaactcgaccccatgaagtcggagtcgctagtaatcgcagatcagcaacgctgcggtgaatacgttcccgggccttgtacacaccgcccgtcaagtcacgaaagttctggtaacacccgaagccggtggcctaacccttgtggggggagccgt

SEQ ID NO: 1002 - DNA, 1384 bp, Chryseobacterium sp.
  Phylum:  Bacteroidetes; Class: Flavobacteriia; Order: Flavobacteriales; Family: Weeksellaceae
agccgagcggtatttcttcttcggaagagagagagcggcgtacgggtgcggaacacgtgtgcaacctacctttatcagggggatagcctttcgaaaggaagattaataccccataatatattgaatggcatcatttaatattgaaaactccggtggatagagatgggcacgcgcaagattagatagttggtgaggtaacggctcaccaagtcaatgatctttagggggcctgagagggtgatcccccacactggtactgagacacggaccagactcctacgggaggcagcagtgaggaatattggacaatgggtgaaagcctgatccagccatcccgcgtgaaggacgacggccctatgggttgtaaacttcttttgtacagggataaacctttccacgtgtggaaagctgaaggtactgtacgaataagcaccggctaactccgtgccagcagccgcggtaatacggagggtgcaagcgttatccggatttattgggtttaaagggtccgtaggcggacctgtaagtcagtggtgaaatctcatagcttaactatgaaactgccattgatactgcaggtcttgagtaaatttgaagtggctggaataagtagtgtagcggtgaaatgcatagatattacttagaacaccaattgcgaaggcaggtcactaagatttaactgacgctgagggacgaaagcgtggggagcgaacaggattagataccctggtagtccacgccgtaaacgatgctaactcgtttttggattttcggattcagagaccaagcgaaagtgataagttagccacctggggagtacgtccgcaaggatgaaactcaaaggaattgacgggggcccgcacaagcggtggattatgtggtttaattcgatgatacgcgaggaaccttaccaagacttaaatgggaaatgacagatttagaaatagatccttcttcggacatttttcaaggtgctgcatggttgtcgtcagctcgtgccgtgaggtgttaggttaagtcctgcaacgagcgcaacccctgtcactagttgctaacattcagttgaggactctagtgagactgcctacgcaagtagagaggaaggtggggatgacgtcaaatcatcacggcccttacgtcttgggccacacacgtaatacaatggccggtacagagggcagctacacagcgatgtgatgcaaatctcgaaagccggtctcagttcggattggagtctgcaactcgactctatgaagctggaatcgctagtaatcgcgcatcagccatggcgcggtgaatacgttcccgggccttgtacacaccgcccgtcaagccatggaagtttggggtacctgaagtcggtgaccgtaaaaggagctgccta

SEQ ID NO: 1003 - DNA, 1362 bp, Agrobacterium sp.
  Phylum:  Proteobacteria; Class: Alphaproteobacteria; Order: Rhizobiales; Family: Rhizobiaceae
accatgcagtcgaacgcatcgcaagatgagtggcagacgggtgagtaacgcgtgggaacatacccttttctacggaatagctctgggaaactggaattaataccgtatacgccctacgggggaaagatttatcggggaaggattggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccgatgaagataatgacggtagtcggagaagcagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattgcgagtgtagaggtgaaattcgtagatattcgcaggaacaccagtggcgaaggcggcttactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtatggtcattggagacgatgaccttcagttcggctggccctagaacaggtgctgcatggctgtcgtcagctcgtgtcgtgagatgttgggataagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggcgctgcgctaaccgcaagggggcaggcgaccacgt

SEQ ID NO: 1004 - DNA, 1356 bp, Agrobacterium larrymoorei
  Phylum:  Proteobacteria; Class: Alphaproteobacteria; Order: Rhizobiales; Family: Rhizobiaceae
catgcagtcgaacgcatcgcagatgagtggcagacgggtgagtaacgcgtgggaacatacccttttctacggaatagctctgggaaactggaattaataccgtatacgccctacgggggaaagatttatcggggaaggattggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccgatgaagataatgacggtagtcggagaagaagccccggctaacttcgtgccagcagccgcggtaatacgaagggggctagcgttgttcagaattactgggcgtaaagcgcacgtaggcggatatttaagtcaggggtgaaatcccagagctcaactctggaactgcctttgatactgggtatcttgagtatggaagaggtaagtggaattgcgagtgtagaggtgaaattcgtagatattcgcaggaacaccagtggcgaaggcggcttactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtatggtcattgggagacgatgaccttcagttcggctggccctagaacaggtgctgcatggctgtcgtcagctcgtgtcgtgagatgttgggataagtcccgcaacgagcgcaaccctcccgcatagttggcagcatttagttgggctctctatcgggactgccggtgatatccgcagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggcgctgcgctaaccgcaagggggcaggcgacc

SEQ ID NO: 1005 - DNA, 1365 bp, Agrobacterium sp.
  Phylum:  Proteobacteria; Class: Alphaproteobacteria; Order: Rhizobiales; Family: Rhizobiaceae
cacatgcagtcgaacgcatcgcaagatgagtggcagacgggtgagtaacgcgtgggaacatacccttttctacggaatagctctgggaaactggaattaataccgtatacgccctacgggggaaagatttatcggggaaggattggcccgcgttggattagctagttggtggggtaaaggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccttagggttgtaaagctctttcaccgatgaagataatgacggtagtcggagaagaagccccggctaacttcgtgccagcagccgcggtaatacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattgcgagtgtagaggtgaaattcgtagatattcgcaggaacaccagtggcgaaggcggcttactggtccattactgacgctgaggtgcgaaagcgtggggagcaaacaggattagataccctggtagtccacgccgtaaacgatgaatgttagccgtcgggcagtatactgttcggtggcgcagctaacgcattaaacattccgcctggggagtacggtcgcaagattaaaactcaaaggaattgacgggggcccgcacaagcggtggagcatgtggtttaattcgaagcaacgcgcagaaccttaccagctcttgacattcggggtatggtcattggagacgatgaccttcagttcggctggcccctagaacaggtgctgcatggctgtcgtcagctcgtgtcgtgagatgttgggttaagtcccgcaacgagcgcaaccctcgcccttagttgccagcatttagttgggcactctaaggggactgccggtgataagccgagaggaaggtggggatgacgtcaagtcctcatggcccttacgggctgggctacacacgtgctacaatggtggtgacagtgggcagcgagacagcgatgtcgagctaatctccaaaagccatctcagttcggattgcactctgcaactcgagtgcatgaagttggaatcgctagtaatcgcagatcagcatgctgcggtgaatacgttcccgggccttgtacacaccgcccgtcacaccatgggagttggttttacccgaaggcgctgcgctaaccgcaagggggcaggcgaccactgta

SEQ ID NO: 1006 - DNA, 1417 bp, Staphylococcus caprae
  Phylum:  Firmicutes; Class: Bacilli; Order: Bacillales; Family: Staphylococcaceae
cagtcgagcgacagacgaggagcttgctcctctgacgttagcggcggacgggttagtaacacgtggataacctacctataagactgggataacttcgggaaaccggagctaataccggataacatgttgaaccgcatggttcaacagtgaaagacggtcttgctgtcacttatagatggatccgcgccgcattagctagttggtaaggtaacggcttaccaaggcaacgatgcgtagccgacctgagagggtgatcggccacactggaactgagacacggtccagactcctacgggaggcagcagtagggaatcttccgcaatgggcgaaagcctgacggagcaacgccgcgtgagtgaagaaggtcttcggatcgtaaaactctgttattagggaagaacaaatgtgtaagtaactatgcacgtcttgacggtacctaatcagaaagccacggctaactacgtgccagcagccgcggtaatacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattcccatgtgtagcggtgaaatgcgcagagatatggaggaacaccagtggcgaaggcgactttctggtctgtaactgacgctgatgtgcgaaagcgtggggatcaaacaggattagataccctggtagtccacgccgtaaacgatgagtgctaagtgttagggggtttccgccccttagtgctgcagctaacgcattaagcactccgcctggggagtacgaccgcaaggttgaaactcaaaggaattgacggggacccgcacaagcggtggagcatgtggtttaattcgaagcaacgcgaagaaccttaccaaatcttgacatcctctgacccctctagagatagagttttccccttcgggggacagagtgacaggtggtgcatggttgtcgtcagctcgtgtcgtgagatgttgggttaagtcccgcaacgagcgcaacccttaagcttagttgccatcattaagttgggcactctaagttgactgccggtgacaaaccggaggaaggtggggatgacgtcaaatcatcatgccccttatgatttgggctacacacgtgctacaatggacaatacaaagggtagcgaaaccgcgaggtcaagcaaatcccataaagttgttctcagttcggattgtagtctgcaactcgactacatgaagctggaatcgctagtaatcgtagatcagcatgctacggtgaatacgttcccgggtcttgtacacaccgcccgtcacaccacgagagtttgtaacacccgaagccgtgtggagtaacctttggagctagcctac

SEQ ID NO: 1007 - DNA, 1422 bp, Bacillus nealsonii
  Phylum:  Firmicutes; Class: Bacilli; Order: Bacillales; Family: Bacillaceae
atgcagtcgagcggacttaaaaagcttgctttttaagttagcggcggacgggtgagtaacacgtgggcaacctgcctgtaagactgggataacttcgggaaaccggagctaataccggataatccttttctactcatgtagaaaagctgaaagacggtttacgctgtcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtacgagagtaactgctcgtaccttgacggtacctaacccagaaagccacgggctaactacgtgccagcagccgcggtaatacgtaggtggcaagcgttgtccggaattattgggcgtaaagcgcgcgcaggcggtcctttaagtctgatgtgaaagcccacggctcaacccgtggagggtcattggaaactgggggacttgagtgcagaagagaagagtggaatttccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatctcctgacaatcctagagataggacgttccccttcgggggacaggatgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggcagcaaaaccgcgaggtcgagccaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtgtgggtaacccttctgggagccagcct

SEQ ID NO: 1008 - DNA, 1426 bp, Bacillus sp.
  Phylum:  Firmicutes; Class: Bacilli; Order: Bacillales; Family: Bacillaceae
taatgcaagtcgagcggactttaaaagcttgcttttaaagttagcggcggacgggtgagtaacacgtgggcaacctgcctgtaagactgggataacttcgggaaaccggagctaataccggataatccttttctactcatgtagaaaagctgaaagacggtttacgctgtcacttacagatgggcccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtacaagagtaactgcttgtaccttgacggtacctaaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaatctgggggacttgagtgcagaagagaagagtggaattccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacactcctagagataggacgttccccttcgggggacagagtgacaggtggtgcatggttgtcgtcagctcgtgtcgtgagatgttgggttaagtcccgcaacgagcgcaacccttgatcttagttgccagcattaagttgggcactttaaggtgactgccggtgacaaaccggaggaaggtggggatgacgtcaaatcatcatgccccttatgacctgggctacacacgtgctacaatggatggtacaaagggcagcaaaaccgcgaggtcgagcaaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaaccgtaaggagccagccgcctaagg

SEQ ID NO: 1009 - DNA, 1424 bp, Bacillus sp.
  Phylum:  Firmicutes; Class: Bacilli; Order: Bacillales; Family: Bacillaceae
tacatgcagtcgagcggacttaaaaagcttgctttttaagttagcggcggacgggtgagtaacacgtgggcaacctgcctgtaagactgggataacttcgggaaaccggagctaataccggataatcctttcctactcatgtaggaaagctgaaagacggtttacgctgtcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtacgagagtaactgctcgtaccttgacggtacctaaccagaaagccacggctaactacgtgccagcagccgcggtaatacgtaggtggcaagcgttgtccgggaattattgggcgtaaagcgcgcgcaggcggtcctttaagtctgatgtgaaagcccacggctcaaccgtggagggtcattggaaactgggggacttgagtgcagaagagaagagtggaattccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatctcctgacaatcctagagataggacgttccccttcgggggacaggatgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggatggtacaaagggcagcaaaaccgcgaggtcgagccaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacccttctgggagccagccgcct

SEQ ID NO: 1010 - DNA, 1421 bp, Bacillus sp.
  Phylum:  Firmicutes; Class: Bacilli; Order: Bacillales; Family: Bacillaceae
gcaagtcgagcggacttaaaaagcttgctttttaagttagcggcggacgggtgagtaacacgtgggcaacctgcctgtaagactgggataacttcgggaaaccggagctaataccggataatccttttctactcatgtagaaaagctgaaagacggtttacgctgtcacttacagatgggcccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtacgagagtaactgctcgtaccttgacggtacctaaccagaaagccacggctaactacgtgccagcagccgcggtaatacgtaggtggcaagcgttgtccggaattattgggcgtaaagcgcgcgcaggcggtcctttaagtctgatgtgaaagcccacggctcaaccgtggagggtcattggaaactgggggacttgagtgcagaagagaagagtggaattccacgtgtagcggtgaaatgcgtagagatgtggaggaacaccagtggcgaaggcgactctttggtctgtaactgacgctgaggcgcgaaagcgtggggagcaaacaggattagataccctggtagtccacgccgtaaacgatgagtgctaagtgttagagggtttccgccctttagtgctgcagcaaacgcattaagcactccgcctggggagtacggccgcaaggctgaaactcaaaggaattgacgggggcccgcacaagcggtggagcatgtggtttaattcgaagcaacgcgaagaaccttaccaggtcttgacatctcctgacaatcctagagataggacgttccccttcgggggacaggatgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggcagcaaaaccgcgaggtcgagccaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggggtaacccttctgggagccagccgcctat

SEQ ID NO: 1011 - DNA, 1414 bp, Luteibacter rhizovicinus
  Phylum:  Proteobacteria; Class: Gammaproteobacteria; Order: Xanthomonadales; Family: Xanthomonadaceae
tgcagtcgaacggcagcacagcagagcttgctctgtgggtggcgagtggcggacgggtgagtaatgcatcgggacctacccagacgtgggggataacgtagggaaacttacgctaataccgcatacgtcctacgggagaaagcgggggatcgcaagacctcgcgcggttggatggaccgatgtgcgattagctagttggtgaggtaatggctcaccaaggcgacgatcgctagctggtctgagaggatgatcagccacactgggactgagacacggcccagactcctacgggaggcagcagtggggaatattggacaatgggcgcaagcctgatccagcaatgccgcgtgtgtgaagaaggccctcgggttgtaaagcacttttatcaggagcgaaatctgcaaggttaatacctttgcagtctgacggtacctgaggaataagcaccggctaactccgtgccagcagccgcggtaatacggagggtgcaagcgttaatcggaattactgggcgtaaagcgtgcgtaggcggttcgttaagtctgctgtgaaagccccgggctcaacctgggaatggcagtggatactggcgagctagagtgtgatagaggatggtggaattcccggtgtagcggtgaaatgcgtagagatcgggaggaacatcagtggcgaaggcggccatctggatcaacactgacgctgaggcacgaaagcgtggggagcaaacaggattagataccctggtagtccacgccctaaacgatgcgaactggatgttggtctcaactcggagatcagtgtcgaagctaacgcgttaagttcgccgcctggggagtacggtcgcaagactgaaactcaaaggaattgacgggggcccgcacaagcggtggagtatgtggtttaattcgatgcaacgcgaagaaccttacctgggcttgacatgtccggaatcctgcagagatgcgggagtgccttcgggaatcggaacacaggtgctgcatggctgtcgtcagctcgtgtcgtgagatgttgggttaagtcccgcaacgagcgcaacccttgtccttagttgccagcgagtaatgtcgggaactctaaggagactgccggtgacaaaccggaggaaggtggggatgacgtcaagtcatcatggcccttacggccagggctacacacgtactacaatggtcggtacagagggttgcgataccgcgaggtggagctaatcccagaaagccgatcccagtccggattggagtctgcaactcgactccatgaagtcggaatcgctagtaatcgcagatcagctatgctgcggtgaatacgttcccgggccttgtacacaccgcccgtcacaccatgggagtgagctgctccagaagccgttagtctaaccgcaagggggacgacgacc

SEQ ID NO: 1012 - DNA, 1361 bp, Unknown
  Description of Unknown: Polynucleotide
  Phylum:  Proteobacteria; Class: Gammaproteobacteria; Order: Enterobacteriales; Family: Enterobacteriaceae
agcttgcttctttgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtaaagttaatacctttgctcattgacgttacccgcagaagaagcaccggctaactccgtgccagcagccgcggtaatacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaagttttcagagatgagaatgtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtagtaa

SEQ ID NO: 1013 - DNA, 1396 bp, Erwinia sp.
  Phylum:  Proteobacteria; Class: Gammaproteobacteria; Order: Enterobacteriales; Family: Enterobacteriaceae
cacatgcagtcggacggtagcacagagagagcttgctccttgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgcggttaataaccgcgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtgggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagctta

SEQ ID NO: 1014 - DNA, 1360 bp, Sphingomonas sp.
  Phylum:  Proteobacteria; Class: Alphaproteobacteria; Order: Sphingomonadales; Family: Sphingomonadaceae
atagcagtcgaacgatgctttcgggcatagtggcgcacgggtgcgtaacgcgtgggaatctgcccttgggtctgggataacagttggaaacgactgctaataccggatgatatcgcgagatcaaagatttatcgcccgaggatgagcccgcgtaggattagctagttggtggggtaaaggcctaccaaggcgacgatccttagctggtctgagaggatgatcagccacactgggactgagacacggcccagactcctacgggaggcagcagtggggaatattggacaatgggcgcaagcctgatccagcaatgccgcgtgagtgatgaaggccttagggttgtaaagctcttttacccgggatgataatgacagtaccgggagaataagccccggctaactccgtgccagcagccgcggtaatacggagggggctagcgttgttcggaattactgggcgtaaagcgcacgtaggcggctttgtaagtcaggggtgaaagcctggagctcaactccagaactgcctttgagactgcatcgcttgaatccgggagaggtaagtggaattccgagtgtagaggtgaaattcgtagatattcggaagaacaccagtggcgaaggcggcttactggaccgggattgacgctgaggtgcgaaagcgtggggagcaaacaggattagataccctggtagtccacgccgtaaacgatgataactagctgtccggggacttggtctttgggtggcgcagctaacgcattaagttatccgcctggggagtacggccgcaaggttaaaactcaaaggaattgacgggggcctgcacaagcggtggagcatgtggtttaattcgaagcaacgcgcagaaccttaccagcgtttgacatgtccggacgatttccagagatggatctcttcccttcggggactgggaacacaggtgctgcatggctgtcgtcagctcgtgtcgtgagatgttgggttaagtcccgcaacgagcgcaaccctcgcctttagttaccatcatttggttgggtactctaaaggaaccgccggtgataagccggaggaaggtggggatgacgtcaagtcctcatggcccttacgcgctgggctacacacgtgctacaatggcgactacagtgggctgcaatcccgcgagggtgagctaatctccaaaagtcgtctcagttcggattgttctctgcaactcgagagcatgaaggcggaatcgctagtaatcgcggatcagcatgccgcggtgaatacgttcccaggccttgtacacaccgcccgtcacaccatgggagttgggttcacccgaaggcgttgcgctaacctcgcaagaggaggcaggcgac

SEQ ID NO: 1015 - DNA, 1390 bp, Microbacterium testaceum
  Phylum:  Actinobacteria; Class: Actinobacteria; Order: Actinomycetales; Family: Microbacteriaceae
cagcagtcgaacggtggagccaagcttgcttggtggatcagtggcgaacgggtgagtaacacgtgagcaacctgccctggactctgggataagcgctggaaacggcgtctaatactggatatgagacgtgatcgcatggtcgtgtttggaaagatttttcggtctgggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacggtttccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtaaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccta

SEQ ID NO: 1016 - DNA, 1408 bp, Microbacterium  chocolatum
  Phylum:  Actinobacteria; Class: Actinobacteria; Order: Actinomycetales; Family: Microbacteriaceae
accatgcagtcgaacggtgaagccaagcttgcttggtggatcagtggcgaacgggtgagtaacacgtgagcaacctgccctggactctgggataagcgctggaaacggcgtctaatactggatatgagacgtgatcgcatggtcgtgtttggaaagatttttcggtctgggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacggtttccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttgggacactcgtaaacaggtgggtgcatgggtagtcgtcagctcgtgtcgtgagatgttggggttaagtcccgcaacgagcgcaaccctcgttctatgttgccagcacgtaatggaggggaactcatggggaaactgccggggtgaactcggcaggaacgaggggtagacgtcaaatcatcatgccccttatgtcttgggcttcacgcatgctacaatggccggtacaaagggctgcaataccgtaaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaaggtg

SEQ ID NO: 1017 - DNA, 1399 bp, Microbacterium  chocolatum
  Phylum:  Actinobacteria; Class: Actinobacteria; Order: Actinomycetales; Family: Microbacteriaceae
ccatgcagtcgacggtgaagccaagcttgcttggtggatcagtggcgaacgggtgagtaacacgtgagcaacctgccctggactctgggataagcgctggaaacggcgtctaatactggatatgagacgtgatcgcatggtcgtgtttggaaagatttttcggtctgggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcggaagcctgatgcagcaacgccgcgtgagggatgacggccttcgggttgtaaacctcttttagcagggaagaagcgaaagtgacggtacctgcagaaaaagcgccggctaactacgtgccagcagccgcggtaatacgtagggcgcaagcgttatccggaattattgggcgtaaagagctcgtaggcggtttgtcgcgtctgctgtgaaatcccgaggctcaacctcgggtctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacggtttccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaaggcttgacatatacgagaacgggccagaaatgggacaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtcgaatg

SEQ ID NO: 1018 - DNA, 1398 bp, Microbacterium  chocolatum
  Phylum:  Actinobacteria; Class: Actinobacteria; Order: Actinomycetales; Family: Microbacteriaceae
gcacatgcagtcgaacggtgaagccaagcttgcttggtggatcagtggcgaacgggtgagtaacacgtgagcaacctgccctggactctgggataagcgctggaaacggcgtctaatactggatatgagacgtgatcgcatggtcgtgtttggaaagatttttcggtctgggatgggctcgcggcctatcagcttgttggtgaggtaatggctcaccaaggcgtcgacgggtagccggcctgagagggtgaccggccacactgggactgagacacggcccagactcctacgggaggcagcagtggggaatattgcacaatgggcgaaagcctgatgcagcaacgccgcgtgagggatgacggccttcgggttgtaaacctcttttagcagggaagaagcgaaagtgacggtacctgcagaaaaaagcgccggctaactacgtgccagcagccgcggtaatacgtagggcgcaagcgttatccgggaattattgggcgtaaagagctcgtaggcggtttgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacaggcttagataccctggtagtccaccccgtaaacgttgggaactagttgtggggaccattccacgggtttccgtgacgcagctaacgcattaagttccccgcctggggagtacggccgcaaggctaaaactcaaaggaattgacggggacccgcacaagcggcggagcatgcggattaattcgatgcaacgcgaagaaccttaccaaggcttgacatatacgagaacgggccagaaatggtcaactctttggacactcgtaaacaggtggtgcatggttgtcgtcagctcgtgtcgtgagatgttgggttaagtcccgcaacgagcgcaaccctcgttctatgttgccagcacgtaatggtgggaactcatgggatactgccggggtcaactcggaggaaggtggggatgacgtcaaatcatcatgccccttatgtcttgggcttcacgcatgctacaatggccggtacaaagggctgcaataccgtgaggtggagcgaatcccaaaaagccggtcccagttcggattgaggtctgcaactcgacctcatgaagtcggagtcgctagtaatcgcagatcagcaacgctgcggtgaatacgttcccgggtcttgtacacaccgcccgtcaagtcatgaaagtcggtaacacctgaagccggtggcccaacccttgtggagggagccgtc

SEQ ID NO: 1019 - DNA, 1433 bp, Bacillus  flexus
  Phylum:  Firmicutes; Class: Bacilli; Order: Bacillales; Family: Bacillaceae
tatacatgcagtcgagcgaactgattagaagcttgcttctatgacgttagcggcggacgggtgagtaacacgtgggcaacctgcctgtaagactgggataacttcgggaaaccgaagctaataccggataggatcttctccttcatgggagatgattgaaagatggtttcggctatcacttacagatgggcccgcggtgcattagctagttggtgaggtaacggctcaccaaggcaacgatgcatagccgacctgagagggtgatcggccacactgggactgagacacggcccagactcctacgggaggcagcagtagggaatcttccgcaatggacgaaagtctgacggagcaacgccgcgtgagtgatgaaggctttcgggtcgtaaaactctgttgttagggaagaacaagtacgagagtaactgcttgtaccttgacggtacctaacccagaaagccacggctaactacgtgccagcagccgcggtaatacgtaggtggcaagcgttatcccggaattattgggcgtaaagcgcgcgcaggcggtttcttaagtctgatgtgaaagcccacggctcaaccgtggagggtcattggaaactggggaacttgagtgcagaagagaaaagcggaattccacgtgtagcggtgaaatgcgtagagatgtggaggaacaccagtggcgaaggcggctttttggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccagggtcttgacatcctctgacaactctagagatagagcgttccccttcgggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggatggtacaaagggctgcaagaccgcgaggtcaagccaatcccataaaaccattctcagttcggattgtaggctgcaactcgcctacatgaagctggaatcgctagtaatcgcggatcagcatgccgcggtgaatacgttcccgggccttgtacacaccgcccgtcacaccacgagagtttgtaacacccgaagtcggtggagtaaccgtaaggagctagccgcctaaa

SEQ ID NO: 1020 - DNA, 1415 bp, Pantoea sp.
  Phylum:  Proteobacteria; Class: Gammaproteobacteria; Order: Enterobacteriales; Family: Enterobacteriaceae
tagtcggacggtagcacagaggagcttgctcctcgggtgacgagtggcggacgggtgagtagtgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacagtgggcgcaagcctgatgcacccatgccgcgtgtatgaagaaggccttcgggttgtaaagtactttcagcggggaggaaggcgatgaggttaataaccttgttgattgacgttacccgcagaagaagcacccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcacgtgcgaaagcgtggggagcaaacacgattagataccctggtagtccacgccgtaaacgatgtcgacttggaggttgttcccttgacgagtggcttccggagctaacgcgttaagtcgaccgcctggggagtacggccgcaaggttaaaactcaaatgaattgacgggggcccgcacaagcggtggagcatgtggttttatttcgatgctacgcgaacaaccttaccctactcttgacatccacggaattcggcagagatgccttggtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgctaccacta

SEQ ID NO: 1021 - DNA, 1420 bp, Erwinia sp.
  Phylum:  Proteobacteria; Class: Gammaproteobacteria; Order: Enterobacteriales; Family: Enterobacteriaceae
acatgcagtcggacggtagcacagaggagcttgctccttgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgcggttaataaccgcgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaacctttacctactcttgacatccagcgaacggggcagagatgccgccgagtgtgcttcgggtacgctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgctaccata

SEQ ID NO: 1022 - DNA, 1412 bp, Erwinia sp.
  Phylum:  Proteobacteria; Class: Gammaproteobacteria; Order: Enterobacteriales; Family: Enterobacteriaceae
catgcagtcggacggtagcacagagagcttgctctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaatggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgcggttaataaccgcgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtacagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagcgaacggagcagagatgccccggtgccttcgggaacgctgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcacaaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgctaccat

SEQ ID NO: 1023 - DNA, 1416 bp, Unknown
  Description of Unknown: Polynucleotide
  Phylum:  Proteobacteria; Class: Gammaproteobacteria; Order: Enterobacteriales; Family: Enterobacteriaceae
acatgcagtcggacggtagcacagaggagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcagtgaggttaataaccttactgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaacctccgggagggcgcttaccat

SEQ ID NO: 1024 - DNA, 1362 bp, Sphingomonas sp.
  Phylum:  Proteobacteria; Class: Alphaproteobacteria; Order: Sphingomonadales; Family: Sphingomonadaceae
cacatgcagtcgaacgagatcttcgggtctagtggcgcacgggtgcgtaacgcgtgggaatctgccctttggttcggaataacagttggaaacgactgctaataccggatgatgacgaaagtccaaagatttatcgccagaggatgagcccgcgtaggattagctagttggtgtggtaaaggcgcaccaaggcgacgatccttagctggtctgagaggatgatcagccacactgggactgagacacggcccagactcctacgggaggcagcagtggggaatattggacaatgggcgaaagcctgatccagcaatgccgcgtgagtgatgaaggccttagggttgtaaagctcttttacccgggatgataatgacagtaccgggagaataagctccggctaactccgtgccagcagccgcggtaatacggagggagctagcgttgttcggaattactgggcgtaaagcgcacgtaggcggctttgtaagttagaggtgaaagcctggagctcaactccagaactgcctttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacaggattagataccctggtagtccacgccgtaaacgatgataactagctgtccggggacttggtctttgggtggcgcagctaacgcattaagttatccgcctggggagtacggccgcaaggttaaaactcaaatgaattgacgggggcctgcacaagcggtggagcatgtggtttaattcgaagcaacgcgcagaaccttaccagcgtttgacatgtccggacgatttccagagatggatctcttcccttcggggactggaacacaggtgctgcatggctgtcgtcagctcgtgtcgtgagatgttgggttaagtcccgcaacgagcgcaaccctcgcctttagttaccatcatttagttggggactctaaaggaaccgccggtgataagccggaggaaggtggggatgacgtcaagtcctcatggcccttacgcgctgggctacacacgtgctacaatggcggtgacagtgggcagcaaactcgcgagagtgcgctaatctccaaaagccgtctcagttcggattgttctctgcaactcgagagcatgaaggcggaatcgctagtaatcgcggatcagcatgccgcggtgaatacgttcccaggccttgtacacaccgcccgtcacaccatgggagttgggttcacccgaaggcgttgcgctaactcgcaagagaggcaggcgaccat

SEQ ID NO: 1025 - DNA, 1418 bp, Unknown
  Description of Unknown: Polynucleotide
  Phylum:  Proteobacteria; Class: Gammaproteobacteria; Order: Enterobacteriales; Family: Enterobacteriaceae
cacatgcagtcgaacggtagcacagaggagcttgctcctcgggtgacgagtggcggacgggtgagtaatgtctgggaaactgcccgatggagggggataactactggaaacggtagctaataccgcataacgtcgcaagaccaaagagggggaccttcgggcctcttgccatcggatgtgcccagatgggattagctggttggtgaggtaatggctcaccaaggcgacgatccctagctggtctgagaggatgaccagccacactggaactgagacacggtccagactcctacgggaggcagcagtggggaatattgcacaatgggcgcaagcctgatgcagccatgccgcgtgtgtgaagaaggccttcgggttgtaaagcactttcagcggggaggaaggcgatacggttaataaccgtgttgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggtcttgacatccacggaattaggcagagatgccttagtgccttcgggaaccgtgagacaggtgctgcatggctgtcgtcagctcgtgttgtgaaatgttgggttaagtcccgcaacgagcgcaacccttatcctttgttgccagcggtccggccgggaactcaaaggagactgccagtgataaactggaggaaggtggggatgacgtcaagtcatcatggcccttacgaccagggctacacacgtgctacaatggcatatacaaagagaagcgacctcgcgagagcaagcggacctcataaagtatgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgctaccatag

SEQ ID NO: 1026 - DNA, 253 bp, Lentzea sp.
  OTU_2152; Phylum: Actinobacteria; Class:  Actinobacteria; Order:  Actinomycetales; Family:  Actinosynnemataceae
tacgtagggcgcaagcgttatccggaattattgggcgtaaagagctcgtaggcggtttgtcgcgtcggccgtgaaaacttggggcttaaccccaagcttgcggtcgatacgggcagacttgagttcggcaggggagactggaattcctggtgtagcggtgaaatgcgcagatatcaggaggaacaccggtggcgaaggcgggtctctgggccgacactgacgctgaggagcgaaagcgtggggatcaaacagg

SEQ ID NO: 1027 - DNA, 253 bp, Unknown
  Description of Unknown: Polynucleotide
  OTU_90; Phylum: Actinobacteria; Class:  Actinobacteria; Order:  Actinomycetales; Family:  Actinosynnemataceae
tacgtagggtgcgagcgttgtccggaattattgggcgtaaagagctcgtaggcggtttgtcgcgtcggccgtgaaaacttggggcttaaccccgagcctgcggtcgatacgggcagacttgagttcggcaggggagactggaattcctggtgtagcggtgaaatgcgcagatatcaggaggaacaccggtggcgaaggcgggtctctgggccgatactgacgctgaggagcgaaagcgtggggagcgaacagg

SEQ ID NO: 1028 - DNA, 253 bp, Brachybacterium sp.
  OTU_309; Phylum: Actinobacteria; Class:  Actinobacteria; Order:  Actinomycetales; Family:  Dermabacteraceae
tacgtagggcgcaagcgttgtccggaattattgggcgtaaagagctcgtaggtggcttgtcgcgtctgccgtgaaaacccgaggctcaacctcgggcgtgcggtgggtacgggcaggctagagtgtggtaggggagactggaactcctggtgtagcggtgaaatgcgcagatatcaggaagaacaccgatggcgaaggcaggtctctgggccattactgacactgaggagcgaaagcatgggtagcgaacagg

SEQ ID NO: 1029 - DNA, 253 bp, Unknown
  Description of Unknown: Polynucleotide
  OTU_2984; Phylum: Actinobacteria; Class:  Actinobacteria; Order:  Actinomycetales; Family:  Geodermatophilaceae
tacgtagggtgcaagcgttgtccggaattattgggcgtaaagagctcgtaggcggtttgttgcgtcggctgtgaaatcccgaggctcaacctcgggtctgcagtcgatacgagcaaactagagtgttgcaggggagactggaattcctggtgtagcggtgaaatgcgcagatatcagggggaacaccggtggcgaaggcgggtctctgggcagcaactgacgctgaggagcgaaagcgtggggagcgaacagg

SEQ ID NO: 1030 - DNA, 253 bp, Glycomyces sp.
  OTU_132; Phylum: Actinobacteria; Class:  Actinobacteria; Order:  Actinomycetales; Family:  Glycomycetaceae
gacgtagggcgcgagcgttgtccggatttattgggcgtaaagggctcgtaggcggttgattgcgtccgccgtgaaaggcctcggcttaaccggggttttgcggtggatacgggtcgacttgaggcaattaggggagatcggaattctacgtgtagcggtgaaatgcgcagatatgtggaggaacaccggtggcgaaggcggatctctgggattgttctgacgctgaggagcgaaagcgtggggagcgaacagg

SEQ ID NO: 1031 - DNA, 253 bp, Phycicoccus sp.
  OTU_1588; Phylum: Actinobacteria; Class:  Actinobacteria; Order:  Actinomycetales; Family:  Intrasporangiaceae
tacgtagggtgcgagcgttgtccggaattattgggcgtaaagagcttgtaggcggtttgtcgcgtctgccgtgaaatttcgaggctcaacctcgaacttgcggtgggtacgggcagactagagtgtggtaggggagactggaattcctggtgtagcggtgaaatgcgcagatatcaggaggaacaccgatggcgaaggcaggtctctgggccactactgacgctgagaagcgaaagcatggggagcgaacagg

SEQ ID NO: 1032 - DNA, 253 bp, Unknown
  Description of Unknown: Polynucleotide
  OTU_161; Phylum: Actinobacteria; Class:  Actinobacteria; Order:  Actinomycetales; Family:  Kineosporiaceae
tacgtagggtgcaagcgttgtccggaattattgggcgtaaagagctcgtaggcggtctgtcgcgtctgctgtgaaaactcagggcttaaccctgagcttgcagtgggtacgggcagactagagtgcggtaggggagactggaattcctggtgtagcggtgaaatgcgcagatatcaggaggaacaccggtggcgaaggcgggtctctgggccgtaactgacgctgaggagcgaaagcatggggagcgaacagg

SEQ ID NO: 1033 - DNA, 253 bp, Unknown
  Description of Unknown: Polynucleotide
  OTU_1207; Phylum: Actinobacteria; Class:  Actinobacteria; Order:  Actinomycetales; Family:  Kineosporiaceae
tacgtagggtgcaagcgttgtccggaattattgggcgtaaagagctcgtaggcggtttgtcgcgtccgctgtgaaaactcggggcttaaccccgggcctgcagtgggtacgggcagactagagtgcggtaggggaggctggaattcctggtgtagcggtgaaatgcgcagatatcaggaggaacaccggtggcgaaggcgggtctctgggccgtaactgacgctgaggagcgaaagcgtggggagcgaacagg

SEQ ID NO: 1034 - DNA, 253 bp, Unknown
  Description of Unknown: Polynucleotide
  OTU_28; Phylum: Actinobacteria; Class:  Actinobacteria; Order:  Actinomycetales; Family:  Microbacteriaceae
tacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacagg

SEQ ID NO: 1035 - DNA, 253 bp, Unknown
  Description of Unknown: Polynucleotide
  OTU_302; Phylum: Actinobacteria; Class:  Actinobacteria; Order:  Actinomycetales; Family:  Microbacteriaceae
tacgtagggtgcaagcgttatccggaattattgggcgtaaagagctcgtaggcggtttgtcgcgtctgctgtgaaaactggaggctcaacctccagcctgcagtgggtacgggcaaactagagtgcggtaggggagattggaattcctggtgtagcggtggaatgcgcagatatcaggaggaacaccgatggcgaaggcagatctctgggccgtaactgacgctgaggagcgaaagcatggggagcgaacagg

SEQ ID NO: 1036 - DNA, 253 bp, Unknown
  Description of Unknown: Polynucleotide
  OTU_3428; Phylum: Actinobacteria; Class:  Actinobacteria; Order:  Actinomycetales; Family:  Microbacteriaceae
tacgtagggtgcaagcgttatccggaattattgggcgtaaagagctcgtaggcggtttgtcgcgtctgctgtgaaaaccggaggctcaacctccgacctgcagtgggtacgggcaaactagagtgcgataagggagattggaattcctggtgtagcggtggaatgcgcagatatcaggaggaacaccgatggcgaaggcagctctctgggccgtaactgacgctgaggagcgaaagcgtggagagcgaacagg

SEQ ID NO: 1037 - DNA, 253 bp, Arthrobacter psychrolactophilus
  OTU_94; Phylum: Actinobacteria; Class:  Actinobacteria; Order:  Actinomycetales; Family:  Micrococcaceae
tacgtagggcgcaagcgttatccggaattattgggcgtaaagagctcgtaggcggtttgtcgcgtctgccgtgaaagtccggggctcaactccggatctgcggtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacagg

SEQ ID NO: 1038 - DNA, 253 bp, Micrococcus sp.
  OTU_2968; Phylum: Actinobacteria; Class:  Actinobacteria; Order:  Actinomycetales; Family:  Micrococcaceae
tacgtagggtgcgagcgttatccggaattattgggcgtaaggagctcgtaggcggtttgtcgcgtctgtcgtgaaagtccggggcttaaccccggatctgcggtgggtacgggcagactagagtgcagtaggggagactggaattcctggtgtagcggtggaatgcgcagatatcaggaggaacaccgatggcgagggcaggtctctgggctgtaactgacgctgaggagcgaaagcatggggagcgaacagg

SEQ ID NO: 1039 - DNA, 253 bp, Unknown
  Description of Unknown: Polynucleotide
  OTU_179; Phylum: Actinobacteria; Class:  Actinobacteria; Order:  Actinomycetales; Family:  Micrococcaceae
tacgtagggcgcaagcgttatccggaattattgggcgtaaagagctcgtaggcggtttgtcgcgtctgctgtgaaagaccggggctcaactccggttctgcagtgggtacgggcagactagagtgcagtaggggagactggaattcctggtgtagcggtgaaatgcgcagatatcaggaggaacaccgatggcgaaggcaggtctctgggctgtaactgacgctgaggagcgaaagcatggggagcgaacagg

SEQ ID NO: 1040 - DNA, 253 bp, Unknown
  Description of Unknown: Polynucleotide
  OTU_200; Phylum: Actinobacteria; Class:  Actinobacteria; Order:  Actinomycetales; Family:  Micromonosporaceae
gacgtagggcgcgagcgttgtccggatttattgggcgtaaagagctcgtaggcggcttgtcgcgtcgactgtgaaaacccgcggctcaaccgcgggcctgcagccgatacgggcaggctagagttcggtaggggagactggaattcctggtgtagcggtgaaatgcgcagatatcaggaggaacaccgatggcgaaggcaggtctctgggccgatactgacgctgaggagcgaaagcgtggggagcgaacagg

SEQ ID NO: 1041 - DNA, 253 bp, Mycobacterium sp.
  OTU_350; Phylum: Actinobacteria; Class:  Actinobacteria; Order:  Actinomycetales; Family:  Mycobacteriaceae
tacgtagggtccgagcgttgtccggaattactgggcgtaaagagctcgtaggtggtttgtcgcgttgttcgtgaaaactcacagcttaactgtgggcgtgcgggcgatacgggcagacttgagtactgcaggggagactggaattcctggtgtagcggtggaatgcgcagatatcaggaggaacaccggtggcgaaggcgggtctctgggcagtaactgacgctgaggagcgaaagcgtggggagcgaacagg

SEQ ID NO: 1042 - DNA, 253 bp, Aeromicrobium sp.
  OTU_100; Phylum: Actinobacteria; Class:  Actinobacteria; Order:  Actinomycetales; Family:  Nocardioidaceae
tacgtagggtccgagcgttgtccggaattattgggcgtaaagggctcgtaggcggtttgtcgcgtcgggagtgaaaactcagggctcaaccctgagcgtgcttccgatacgggcagactagaggtatgcaggggagaacggaattcctggtgtagcggtggaatgcgcagatatcaggaggaacaccggtggcgaaggcggttctctgggcattacctgacgctgaggagcgaaagcatggggagcgaacagg

SEQ ID NO: 1043 - DNA, 253 bp, Aeromicrobium sp.
  OTU_3177; Phylum: Actinobacteria; Class:  Actinobacteria; Order:  Actinomycetales; Family:  Nocardioidaceae
tacgtagggtccgagcgttgtccggaattattgggcgtaaagggctcgtaggcggtttgtcacgtcgggcgtgaaaactcagggctcaaccctgagcgtgcgttcgatacgggcagactagaggtatgcaggggagaacggaattcctggtgtagcggtggaatgcgcagatatcaggaagaacaccggtggcgaaggcggctctctgggccttacctgacgctgaggagcgaaagcatgggtagcgaacagg

SEQ ID NO: 1044 - DNA, 253 bp, Kribbella sp.
  OTU_1142; Phylum: Actinobacteria; Class:  Actinobacteria; Order:  Actinomycetales; Family:  Nocardioidaceae
tacgtagggtgcaagcgttgtccggaattattgggcgtaaagggctcgtaggcggttcgtcacgtcgggagtgaaaactcggagctcaactccgagccggcttccgatacgggcagactagaggtaggcaggggagagtggaactcctggtgtagcggtggaatgcgcagatatcaggaagaacaccagtggcgaaggcggctctctgggccttacctgacgctgaggagcgaaagcgtgggtagcgaacagg

SEQ ID NO: 1045 - DNA, 253 bp, Kribbella sp.
  OTU_238; Phylum: Actinobacteria; Class:  Actinobacteria; Order:  Actinomycetales; Family:  Nocardioidaceae
tacgtagggtccgagcgttgtccggaattattgggcgtaaagggctcgtaggcggttcgtcacgtcgggagtgaaaactcggggcttaaccccgagcctgcttccgatacgggcagactagaggtaggcaggggagagcggaactcctggtgtagcggtggaatgcgcagatatcaggaagaacaccggtggcgaaggcggctctctgggccttacctgacgctgaggagcgaaagcgtgggtagcgaacagg

SEQ ID NO: 1046 - DNA, 253 bp, Unknown
  Description of Unknown: Polynucleotide
  OTU_730; Phylum: Actinobacteria; Class:  Actinobacteria; Order:  Actinomycetales; Family:  Nocardioidaceae
tacgtagggtgcgagcgttgtccggaattattgggcgtaaagggctcgtaggcggtctgttgcgtcgggagtgaaaactcagggcttaaccctgagcctgcttccgatacgggcagactagaggtatgcaggggagaacggaattcctggtgtagcggtgaaatgcgcagatatcaggaggaacaccggtggcgaaggcggttctctgggcattacctgacgctgaggagcgaaagtgtggggagcgaacagg

SEQ ID NO: 1047 - DNA, 253 bp, Unknown
  Description of Unknown: Polynucleotide
  OTU_992; Phylum: Actinobacteria; Class:  Actinobacteria; Order:  Actinomycetales; Family:  Nocardioidaceae
tacgtagggtgcgagcgttgtccggaattattgggcgtaaagggctcgtaggcggtttgtcgcgtcgggagtgaaaacgccgtgcttaacacggcgcttgctttcgatacgggcagactagaggtattcaggggagaacggaattcctggtgtagcggtgaaatgcgcagatatcaggaggaacaccggtggcgaaggcggttctctgggaatgacctgacgctgaggagcgaaagtgtggggagcgaacagg

SEQ ID NO: 1048 - DNA, 253 bp, Cellulosimicrobium sp.
  OTU_392; Phylum: Actinobacteria; Class:  Actinobacteria; Order:  Actinomycetales; Family:  Promicromonosporaceae
tacgtagggcgcaagcgttgtccggaattattgggcgtaaagagctcgtaggcggtttgtcgcgtctggtgtgaaaactcgaggctcaacctcgagcttgcatcgggtacgggcagactagagtgcggtaggggagactggaattcctggtgtagcggtggaatgcgcagatatcaggaggaacaccgatggcgaaggcaggtctctgggccgcaactgacgctgaggagcgaaagcatggggagcgaacagg

SEQ ID NO: 1049 - DNA, 253 bp, Promicromonospora sp.
  OTU_91; Phylum: Actinobacteria; Class:  Actinobacteria; Order:  Actinomycetales; Family:  Promicromonosporaceae
tacgtagggcgcaagcgttgtccggaattattgggcgtaaagagctcgtaggcggtctgtcgcgtctggtgtgaaatcccatggctcaactgtgggcttgcatcgggtacgggcagactagagtgctgtaggggagactggaattcctggtgtagcggtggaatgcgcagatatcaggaggaacaccgatggcgaaggcaggtctctgggcagttactgacgctgaggagcgaaagcatggggagcgaacagg

SEQ ID NO: 1050 - DNA, 254 bp, Pseudonocardia sp.
  OTU_134; Phylum: Actinobacteria; Class:  Actinobacteria; Order:  Actinomycetales; Family:  Pseudonocardiaceae
tacgtagggtgcgagcgttgtccggaattattgggcgtaaagagctcgtaggcggtgtgtcacgtcgatcgtgaaaacttggggcttaaccctgagcgtgcggtcgatacgggcatcactagagttcggcaggggagactggaattcctggtgtagcggtgaaatgcgcagatatcaggaggaacaccggtggcgaaggcgggtctctgggccgatactgacgctgaggagcgaaagcgtggggagcgaacagg

SEQ ID NO: 1051 - DNA, 253 bp, Streptomyces mirabilis
  OTU_573; Phylum: Actinobacteria; Class:  Actinobacteria; Order:  Actinomycetales; Family:  Streptomycetaceae
tacgtagggcgcaagcgttgtccggaattattgggcgtaaagagctcataggcggcttgtcacgtcgggtgtgaaagcccggggcttaaccccgggcctgcattcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacagg

SEQ ID NO: 1052 - DNA, 254 bp, Streptomyces sp.
  OTU_3556; Phylum: Actinobacteria; Class:  Actinobacteria; Order:  Actinomycetales; Family:  Streptomycetaceae
tacgtagggcgcaagcgttgtccggaattattgggcgtaaagagctcgtaggcggcttgtcacgtcggatgtgaaagcccggggcttaaccccgggtctgcattcgatacgggctagctagagtgtggtaggggagatcggaattcctggtgtagcggtgaaatgcgcagatatcaggaggaacaccggtggcgaaggcggatctctgggccattactgacgctgaggagacgaaagctaggggagcgaatggg

SEQ ID NO: 1053 - DNA, 253 bp, Unknown
  Description of Unknown: Polynucleotide
  OTU_88; Phylum: Actinobacteria; Class:  Actinobacteria; Order:  Actinomycetales; Family:  Streptomycetaceae
tacgtagggcgcaagcgttgtccggaattattgggcgtaaagagctcgtaggcggtctgtcgcgtcggatgtgaaagcccggggcttaaccccgggtctgcattcgatacgggcagactagagtgtggtaggggagatcggaattcctggtgtagcggtgaaatgcgcagatatcaggaggaacaccggtggcgaaggcggatctctgggccattactgacgctgaggagcgaaagcgtggggagcgaacagg

SEQ ID NO: 1054 - DNA, 253 bp, Unknown
  Description of Unknown: Polynucleotide
  OTU_409; Phylum: Actinobacteria; Class:  Actinobacteria; Order:  Actinomycetales; Family:  Streptomycetaceae
tacgtagggtgcgagcgttgtccggaattattgggcgtaaagagctcgtaggcggcttgtcacgtcggatgtgaaagcccggggcttaaccccgggtctgcattcgatacgggcaggctagagtgtggtaggggagatcagaattcctggtgtagcggtgaaatgcgcaaatatcaggaggaacaccggtggcgaaggcggatctctgggccattactgacgctgaggagcgaaagcgtggggagcgaacagg

SEQ ID NO: 1055 - DNA, 253 bp, Unknown
  Description of Unknown: Polynucleotide
  OTU_882; Phylum: Actinobacteria; Class:  Actinobacteria; Order:  Actinomycetales
tacgtagggtgcaagcgttgtccggaattattgggcgtaaagagttcgtaggcggtttgtcgcgtccgttgtgaaagcttggggctcaaccccaagtctgcagtggatacgggcagactagagtcaggtaggggagaacggaattcctggtgtagcggtgaaatgcgcagatatcaggaggaacaccggtggcgaaggcggttctctgggcctgtactgacgctgaggaacgaaagcgtggggagcgaacagg

SEQ ID NO: 1056 - DNA, 253 bp, Unknown
  Description of Unknown: Polynucleotide
  OTU_713; Phylum: Actinobacteria; Class:  Thermoleophilia; Order:  Gaiellales; Family:  Gaiellaceae
tacgtagggggcaagcgttgtccggatttattgggcgtaaagagcgtgtaggcggccattcaggtcagctgtgaaaactcgaggctcaacctcgagacgtcggttgaaaccgtttggctagagtccggaagaggagagtggaattcccggtgtagcggtgaaatgcgcagatatcgggaagaacacccgtggcgaaggcggctctctgggacggtactgacgctgagacgcgaaagcgtggggagcgaacagg

SEQ ID NO: 1057 - DNA, 253 bp, Chitinophaga sp.
  OTU_402; Phylum: Bacteroidetes; Class:  Saprospirae; Order:  Saprospirales; Family:  Chitinophagaceae
tacggagggtgcaagcgttatccggattcactgggtttaaagggtgcgtaggcggattattaagtccgtggtgaaatctccaagcttaacttggaaactgccatggatactattagtcttgaatgttgtggaggttagcggaatatgtcatgtagcggtgaaatgcatagatatgacatagaacaccaattgcgaaggcagctggctacacaaatattgacgctgaggcacgaaagcgtggggatcaaacagg

SEQ ID NO: 1058 - DNA, 253 bp, Chitinophaga sp.
  OTU_3325; Phylum: Bacteroidetes; Class:  Saprospirae; Order:  Saprospirales; Family:  Chitinophagaceae
tacggagggtgcaagcgttatccggattcactgggcttaaagggtgcgtaggcggatttgtaagtccgtggtgaaatctctaagcttaacttggaaactgccatggatactataagtcttgaatattgtggaggttagcggaatatgtcatgtagcggtgaaatgcatagatacgacatagaacaccaattgcgaaggcagctggctacacaaatattgacgctgatgcacgaaagcgtggggatcaaacagg

SEQ ID NO: 1059 - DNA, 253 bp, Lacibacter cauensis
  OTU_218; Phylum: Bacteroidetes; Class:  Saprospirae; Order:  Saprospirales; Family:  Chitinophagaceae
tacggagggtgcaagcgttatccggattcactgggtttaaagggagcgtaggtggacttttaagtcagtggtgaaatctctgggcttaacccggaaactgccattgatactattagtcttgaattctctggaggtaagcggaatatgtcatgtagcggtgaaatgcttagatatgacatagaacacccattgcgaaggcagcttactacggagacattgacactgaggctcgaaagcgtggggatcaaacagg

SEQ ID NO: 1060 - DNA, 253 bp, Sediminibacterium sp.
  OTU_57; Phylum: Bacteroidetes; Class:  Saprospirae; Order:  Saprospirales; Family:  Chitinophagaceae
tacggagggtgcaagcgttatccggattcactgggtttaaagggtgcgtaggcgggtatgtaagtcagtggtgaaataccggagcttaacttcggaactgccattgatactatatatcttgaatattgtggaggtaagcggaatatgtcatgtagcggtgaaatgcttagagatgacatagaacaccgattgcgaaggcagcttgctacgcaaatattgacgctgaggcacgaaagcgtggggatcaaacagg

SEQ ID NO: 1061 - DNA, 253 bp, Unknown
  Description of Unknown: Polynucleotide
  OTU_213; Phylum: Bacteroidetes; Class:  Saprospirae; Order:  Saprospirales; Family:  Chitinophagaceae
tacggagggtgcaagcgttatccggattcactgggtttaaagggtgcgtaggtgggttggtaagtcagtggtgaaatctccgagcttaacttggaaactgccgttgatactatcaatcttgaatatcgcgtaggtaagcggaatatgtcatgtagcggtgaaatgcttagatatgacatagaacaccaattgcgaaggcagcttacttcacgatcattgacactgaggcacgaaagcgtggggagcaaacagg

SEQ ID NO: 1062 - DNA, 253 bp, Unknown
  Description of Unknown: Polynucleotide
  OTU_362; Phylum: Bacteroidetes; Class:  Saprospirae; Order:  Saprospirales; Family:  Chitinophagaceae
tacggagggtgcaagcgttatccggattcactgggtttaaagggtgcgtaggtgggttggtaagtcagtggtgaaatccccgagcttaacttgggaactgccattgatactatcagtcttgaataccgtggaggttagcggaatatgtcatgtagcggtgaaatgcttagatatgacatagaacaccaattgcgaaggcagctggctacacgaatattgacactgaggcacgaaagcgtggggatcaaacagg

SEQ ID NO: 1063 - DNA, 253 bp, Unknown
  Description of Unknown: Polynucleotide
  OTU_348; Phylum: Bacteroidetes; Class:  Saprospirae; Order:  Saprospirales; Family:  Chitinophagaceae
tacggagggtgcaagcgttatccggatttactgggtttaaagggtgcgtaggtgggtaggtaagtcagtggtgaaatcttcaagcttaacttggaaactgccattgatactatttatcttgaatactttggaggtaagcggaatatgtcatgtagcggtgaaatgcttagatatgacatagaacaccaattgcgaaggcagcttactacacagttattgacactgaggcacgaaagcgtggggatcaaacagg

SEQ ID NO: 1064 - DNA, 253 bp, Unknown
  Description of Unknown: Polynucleotide
  OTU_208; Phylum: Bacteroidetes; Class:  Saprospirae; Order:  Saprospirales; Family:  Chitinophagaceae
tacggagggtgcaagcgttatccggattcactgggtttaaagggagcgcaggcggatttgtaagtcagtggtgaaaggcttaagcttaacttgggaactgccattgatactataagtcttgaatgttgttgaggtttgcggaatgggtcatgtagcggtgaaatgcatagatatgacccggaacacctattgcgaaggcagcaggctaaacaaatattgacgctgaggctcgaaagcgtggggatcaaacagg

SEQ ID NO: 1065 - DNA, 253 bp, Unknown
  Description of Unknown: Polynucleotide
  OTU_237; Phylum: Bacteroidetes; Class:  Saprospirae; Order:  Saprospirales; Family:  Chitinophagaceae
tacggagggtgcaagcgttatccggattcactgggtttaaagggtgcgtaggtgggctagtaagtccgtggtgaaatctctgagcttaactcggaaactgccgtggatactattagtcttgaatctcgtggaggtaagcggaatatgtcatgtagcggtgaaatgcttagatatgacatagaacaccgatagcgaaggcagcttgctacacgagtattgacactgaggcacgaaagcgtggggatcaaacagg

SEQ ID NO: 1066 - DNA, 253 bp, Algoriphagus terrigena
  OTU_163; Phylum: Bacteroidetes; Class:  Cytophagia; Order:  Cytophagales; Family:  Cyclobacteriaceae
tacggagggtgcaagcgttgtccggatttattgggtttaaagggtgcgtaggcggctatttaagtcagcggtgaaagacatcggctcaaccgatgcagtgccattgatactggatagcttgagtgttggaggggtacatggaattgatggtgtagcggtgaaatgcatagataccatcaggaacaccgatagcgaaggcattgtactggccaacaactgacgctgaggcacgaaagcatgggtagcgaacagg

SEQ ID NO: 1067 - DNA, 253 bp, Dyadobacter sp.
  OTU_112; Phylum: Bacteroidetes; Class:  Cytophagia; Order:  Cytophagales; Family:  Cytophagaceae
tacggagggtgcgagcgttgtccggatttattgggtttaaagggtgcgtaggtggctgtttaagtcagtggtgaaatacggttgctcaacaatcgaggtgccattgatactgaatagcttgaaataattggaggctgccggaatggatggtgtagcggtgaaatgcatagatatcatccagaacaccgattgcgaaggcaggtggctacgattggtttgacactgaggcacgaaagcatggggagcaaacagg

SEQ ID NO: 1068 - DNA, 253 bp, Dyadobacter sp.
  OTU_120; Phylum: Bacteroidetes; Class:  Cytophagia; Order:  Cytophagales; Family:  Cytophagaceae
tacggagggtgcgagcgttgtccggatttattgggtttaaagggtgcgtaggtggctttttaagtcagtggtgaaatacagccgctcaacggttgaggtgccattgatactgaagagcttgaaacaagtggaggctgccggaatggatggtgtagcggtgaaatgcatagatatcatccagaacaccgattgcgaaggcaggtggctacgtttgatttgacactgaggcacgaaagcatggggagcaaacagg

SEQ ID NO: 1069 - DNA, 254 bp, Emticicia sp.
  OTU_234; Phylum: Bacteroidetes; Class:  Cytophagia; Order:  Cytophagales; Family:  Cytophagaceae
tacgtaggtggcgagcgttatccggatttattgggtttaaagggtgcgtaggcggctgattaagtcagcggtgaaaggtagcagcttaactgttttacatgccgttgatactggttagcttgagttgacagaaggcagatagaatttctggtgtagcggtgaaatgcttagataccaggaggaataccgattgcgaaggcagtctgctgcagtcacactgacgctgaggcacgaaagtgcggggatcaaacagg

SEQ ID NO: 1070 - DNA, 253 bp, Unknown
  Description of Unknown: Polynucleotide
  OTU_210; Phylum: Bacteroidetes; Class:  Cytophagia; Order:  Cytophagales; Family:  Cytophagaceae
tacgtaggtggcaagcgttgtccggatttattgggtttaaagggtgcgtaggcggtctattaagtcagtggtgaaatatcgcagcttaactgtgagggtgccattgatactgatggacttgagtgaagtcgaagtaggcggaattgacggtgtagcggtgaaatgcttagatatcgtcaagaacaccgatagtgaagacagcttactaggcttatactgacgctgaggcacgaaagtgtggggatcaaacagg

SEQ ID NO: 1071 - DNA, 253 bp, Unknown
  Description of Unknown: Polynucleotide
  OTU_187; Phylum: Bacteroidetes; Class:  Cytophagia; Order:  Cytophagales; Family:  Cytophagaceae
tacgtaggtggcaagcgttgtccggatttattgggtttaaagggtgcgtaggtggttccataagtcagtggtgaaatacggcagcttaactgtcgaggtgccattgatactgcggaacttgagtacagacgaggtaggcggaattgacggtgtagcggtgaaatgcttagatatcgtcaagaacaccgatagcgaaggcagcttactagactgtaactgacactgaggcacgaaagtgtggggatcaaacagg

SEQ ID NO: 1072 - DNA, 253 bp, Unknown
  Description of Unknown: Polynucleotide
  OTU_152; Phylum: Bacteroidetes; Class:  Cytophagia; Order:  Cytophagales; Family:  Cytophagaceae
tacggagggtgcaagcgttgtccggatttattgggtttaaagggtgcgtaggtggctgtttaagtcagtggtgaaagcctgcagcttaactgtaggactgccattgatactgaatagcttgagtactgatgaggtaggcggaattgatagtgtagcggtgaaatgcatagatattatcaagaacaccgattgcgaaggcagcttactaaggagttactgacactgaggcacgaaagcgtggggatcaaacagg

SEQ ID NO: 1073 - DNA, 253 bp, Unknown
  Description of Unknown: Polynucleotide
  OTU_1201; Phylum: Bacteroidetes; Class:  Cytophagia; Order:  Cytophagales; Family:  Cytophagaceae
tacgtaggtggcaagcgttgtccggatttattgggtttaaagggtgcgtaggcggttctataagtcagtggtgaaatacggcagctcaactgtcgaggtgccattgatactgtaggactagagtactgttgaggtaggcggaatggacggtgtggcggtgaaatgcttagatatcgtccagaacaccgatagcgaaggcagcttactaaggagtaactgacgctgaggcacgaaagtgtggggatcaaacagg

SEQ ID NO: 1074 - DNA, 253 bp, Unknown
  Description of Unknown: Polynucleotide
  OTU_287; Phylum: Bacteroidetes; Class:  Cytophagia; Order:  Cytophagales; Family:  Cytophagaceae
tacgtaggtggcgagcgttgtccggatttattgggtttaaagggtgcgtaggcggttttgtaagtcagtgctgaaatatcccggcttaaccgggagggtggcattgatactgcaggacttgagtaaagttgaggtgggcggaattgacggtgtagcggtgaaatgcttagatatcgtcaagaacaccgattgcgaaggcagctcactaagctttaactgacgctgaggcacgaaagtgtggggatcaaacagg

SEQ ID NO: 1075 - DNA, 253 bp, Unknown
  Description of Unknown: Polynucleotide
  OTU_377; Phylum: Bacteroidetes; Class:  Cytophagia; Order:  Cytophagales; Family:  Cytophagaceae
tacgtaggtggcaagcgttgtccggatttattgggtttaaagggtgcgtaggcggtcttttaagtcagtgctgaaatactccagcttaactggaggggtggcattgatactggaagacttgagtgtagtcgaagtaggcggaattgacggtgtagcggtgaaatgcttagatatcgtcaagaacaccgatagtgaagacagcttactaggctacaactgacgctgaggcacgaaagtgtggggatcaaacagg

SEQ ID NO: 1076 - DNA, 253 bp, Unknown
  Description of Unknown: Polynucleotide
  OTU_2342; Phylum: Bacteroidetes; Class:  Cytophagia; Order:  Cytophagales; Family:  Cytophagaceae
tacgtaggtggcaagcgttgtccggatttattgggcttaaagggtgcgtaggcggttatataagtcagtgctgaaatatcccggcttaaccgggagggtggcattgatactgtatgacttgagtaaagttgaggttggcggaattgacggtgtagcggtgaaacgcttagatatcgtcaagaacaccgattgcgaaggcagctaactaagctttaactgacgctgaggcacgaaagtgtggggatcaaacagg

SEQ ID NO: 1077 - DNA, 253 bp, Unknown
  Description of Unknown: Polynucleotide
  OTU_487; Phylum: Bacteroidetes; Class:  Cytophagia; Order:  Cytophagales
tacggagggtgcaagcgttgtccggatttattgggtttaaagggtgcgtaggtggcttattaagtcagtgtttaaagtcaatagctcaactattggaatggcattgatactgatgagcttgagtaaagttgaggtagacagaattgatggtgtagcggtgaaatgcatagatatcatcaagaataccgattgcgaaggcagtttactaagctttaactgacactgaggcacgaaagtgtggggatcaaacagg

SEQ ID NO: 1078 - DNA, 253 bp, Fluviicola sp.
  OTU_276; Phylum: Bacteroidetes; Class:  Flavobacteriia; Order:  Flavobacteriales; Family:  Cryomorphaceae
tacggagggtgcaagcgttatccggaatcattgggtttaaagggtccgcaggcggtcttataagtcagtggtgaaagcctacagctcaactgtagaactgccattgatactgtaagacttgaattcgatcgaagtgggcggaatatgacatgtagcggtgaaatgcttagatatgtcatagaacaccgatagcgaaggcagctcactaggtctggattgacgctcagggacgaaagcgtggggagcaaacagg

SEQ ID NO: 1079 - DNA, 253 bp, Flavobacterium columnare
  OTU_141; Phylum: Bacteroidetes; Class:  Flavobacteriia; Order:  Flavobacteriales; Family:  Flavobacteriaceae
tacggaggatccaagcgttatccggaatcattgggtttaaagggtccgtaggcggttttataagtcagtggtgaaatctggtcgctcaacgatcaaacggccattgatactgtagaacttgaattacttggaagtaactagaatatgtagtgtagcggtgaaatgcttagagattacatggaataccaattgcgaaggcaggttactacgagtatattgacgctgatggacgaaagcgtggggagcgaacagg

SEQ ID NO: 1080 - DNA, 253 bp, Flavobacterium succinicans
  OTU_148; Phylum: Bacteroidetes; Class:  Flavobacteriia; Order:  Flavobacteriales; Family:  Flavobacteriaceae
tacggaggatccaagcgttatccggaatcattgggtttaaagggtccgtaggcggtttggtaagtcagtggtgaaagcccatcgctcaacggtggaacggccattgatactgccagacttgaattattaggaagtaactagaatatgtagtgtagcggtgaaatgcttagagattacatggaataccaattgcgaaggcaggttactactaatggattgacgctgatggacgaaagcgtgggtagcgaacagg

SEQ ID NO: 1081 - DNA, 253 bp, Flavobacterium succinicans
  OTU_3571; Phylum: Bacteroidetes; Class:  Flavobacteriia; Order:  Flavobacteriales; Family:  Flavobacteriaceae
tacggaggatccgagcgttatccggaatcattgggtttaaagggtccgtaggcggtttaataagtcagtggtgaaagcccatcgctcaacggtggaacggccattgatactgttaaacttgaattattaggaagtaactagaatatgtagtgtagcggtgaaatgcttagagattacatggaataccaattgcgaaggcaggttactactaatgggttggcgctgatggacgaaagcgtgggtagcgaacagg

SEQ ID NO: 1082 - DNA, 253 bp, Flavobacterium sp.
  OTU_3528; Phylum: Bacteroidetes; Class:  Flavobacteriia; Order:  Flavobacteriales; Family:  Flavobacteriaceae
tacggaggatccaagcgttatccggaatcattgggtttaaagggtccgtaggcggcttgataagtcagtggtgaaagcccatcgctcaacgatggaacggccattgatactgtcagacttgaattactgggaagtaactagaatatgtagtgtagcggtgaaatgcttagatattacatggaataccaattgcgaaggcaggttactaccagtggattgacgctgatggacgaaagcgtggggagcgaacagg

SEQ ID NO: 1083 - DNA, 253 bp, Pedobacter sp.
  OTU_67; Phylum: Bacteroidetes; Class:  Sphingobacteriia; Order:  Sphingobacteriales; Family:  Sphingobacteriaceae
tacggaggatccaagcgttatccggatttattgggtttaaagggtgcgtaggcggcctgttaagtcaggggtgaaagacggtagctcaactatcgcagtgcccttgatactgatgggcttgaatggactagaggtaggcggaatgagacaagtagcggtgaaatgcatagatatgtctcagaacaccgattgcgaaggcagcttactatggtcttattgacgctgaggcacgaaagcgtggggatcaaacagg

SEQ ID NO: 1084 - DNA, 253 bp, Pedobacter sp.
  OTU_109; Phylum: Bacteroidetes; Class:  Sphingobacteriia; Order:  Sphingobacteriales; Family:  Sphingobacteriaceae
tacggaggatccaagcgttatccggatttattgggtttaaagggtgcgtaggcggcttattaagtcaggggtgaaagacggtggctcaaccatcgcagtgcccttgatactgatgagcttgaatgaactagaggtaggcggaatgtgacaagtagcggtgaaatgcatagatatgtcacagaacaccgattgcgaaggcagcttactatggttttattgacgctgaggcacgaaagcgtggggatcaaacagg

SEQ ID NO: 1085 - DNA, 253 bp, Unknown
  Description of Unknown: Polynucleotide
  OTU_3687; Phylum: Bacteroidetes; Class:  Sphingobacteriia; Order:  Sphingobacteriales; Family:  Sphingobacteriaceae
tacggaggatccaagcgttatccggatttattggatttaaagggtgcgtaggcggcttattaagtcaggggtgaaagacggtggctcaaccatcgcagtgcccttgctactgatgagcttgaatacattagaggtaggcggaatgtgacaagtagcggtgaaatgcatagatatgtcacagaacaccgattgcgaaggcagcttactatgatgagattgacgctgaggcacgaaagcgtggggatcaaacagg

SEQ ID NO: 1086 - DNA, 253 bp, Unknown
  Description of Unknown: Polynucleotide
  OTU_3184; Phylum: Bacteroidetes; Class:  Sphingobacteriia; Order:  Sphingobacteriales; Family:  Sphingobacteriaceae
tacggaggatccgagcgttatccggatttattgggtttaaagggtgcgtaggcggcctattaagtcaggggtgaaagacggtagcttaactatcgcagtgcctttgatactgataggcttgaatgtacttgaggtaggcggaatgtgacaagtagcggtgaaatgcatagatatgtcacagaacaccaattgcgaaggcagcttgctaaagtatgattgacgctgaggcacgaaagcgtggggatcaaacagg

SEQ ID NO: 1087 - DNA, 253 bp, Unknown
  Description of Unknown: Polynucleotide
  OTU_3212; Phylum: Bacteroidetes; Class:  Sphingobacteriia; Order:  Sphingobacteriales; Family:  Sphingobacteriaceae
tacggaggatccaagcgttatccggatttattgggtttaaagggtgcgtaggcggcctattaagtcaggggtgaaagacggtagctttactatcgcagtgcccttggtactgatgggcttgaatacactagaggtaggcggaatgtgacaagtagcggtgaaatgcatagatatgtcacagaacaccaattgcgaaggcagcttactatggtgtcattgacgctgaggcacgaaagcgtggggatcaaacagg

SEQ ID NO: 1088 - DNA, 252 bp, Unknown
  Description of Unknown: Polynucleotide
  OTU_3301; Phylum: Bacteroidetes; Class:  Sphingobacteriia; Order:  Sphingobacteriales; Family:  Sphingobacteriaceae
tacgaggatccaagcgttatccggatttattgggtttaaagggtgcgtaggtggctttttaagtcaggggtgaaagacggtagcttaactatcgcagtgcctttgatactgaagagcttgaatgaactagaggtaggcggaatgtgacaagtagcggtgaaatgcatagatatgtcacagaacaccaattgcgaaggcagcttactagggttttattgacactgaggcacgaaagcgtggggagcaaacagg

SEQ ID NO: 1089 - DNA, 253 bp, Unknown
  Description of Unknown: Polynucleotide
  OTU_86; Phylum: Bacteroidetes; Class:  Sphingobacteriia; Order:  Sphingobacteriales; Family:  Sphingobacteriaceae
tacggaggatccaagcgttatccggatttattgggtttaaagggtgcgtaggcggctttttaagtcaggggtgaaagacggtagctcaactatcgcagtgcccttgatactgaagagcttgaatgtacttgaggtaggcggaatgtgacaagtagcggtgaaatgcatagatatgtcacagaacaccaattgcgaaggcagcttactaaagtatgattgacgctgaggcacgaaagcgtggggatcaaacagg

SEQ ID NO: 1090 - DNA, 253 bp, Unknown
  Description of Unknown: Polynucleotide
  OTU_406; Phylum: Bacteroidetes; Class:  Sphingobacteriia; Order:  Sphingobacteriales; Family:  Sphingobacteriaceae
gacgtaggatgcgagcgttatccggatttattgggtttaaagggtgcgtaggcggcctgttaagtcaggggtgaaagacggtagctcaactatcgcagtgcccttgatactgatgggcttgaatgtactagaggtaggcggaatgtgacaagtagcggtgaaatgcatagatatgtcacagaacaccaattgcgaaggcagcttactatggtattattgacgctgaggcacgaaagcgtggggatcaaacagg

SEQ ID NO: 1091 - DNA, 253 bp, Unknown
  Description of Unknown: Polynucleotide
  OTU_129; Phylum: Bacteroidetes; Class:  Sphingobacteriia; Order:  Sphingobacteriales; Family:  Sphingobacteriaceae
tacggaggatccaagcgttatccggatttattgggtttaaagggtgcgtaggtggttctttaagtcaggggtgaaagacggcagcttaactgtcgcagtgcctttgatactgaagaacttgaatacactagaggtaggcggaatgtgacaagtagcggtgaaatgcatagatatgtcacagaacaccaattgcgaaggcagcttactatggtgtcattgacactgaggcacgaaagcgtggggatcaaacagg

SEQ ID NO: 1092 - DNA, 253 bp, Unknown
  Description of Unknown: Polynucleotide
  OTU_2892; Phylum: Bacteroidetes; Class:  Sphingobacteriia; Order:  Sphingobacteriales; Family:  Sphingobacteriaceae
tacggaggatccaagcgttatccggatttattgggtttaaagggtgcgtaggcggcctattaagtcaggggtgaaagacggtagcttaactatcgcagtgcctttgatactgacgggcttgaatggactagaggtaggcggaatgtgacaagtagcggtgaaatgcatagatatgtcacagaacaccaattgcgaaggcagcttactatggtttaattgacgctgaggcacgaaagcgtggggatcaaacagg

SEQ ID NO: 1093 - DNA, 253 bp, Unknown
  Description of Unknown: Polynucleotide
  OTU_3722; Phylum: Bacteroidetes; Class:  Sphingobacteriia; Order:  Sphingobacteriales; Family:  Sphingobacteriaceae
tacggaggatccaagcgttatccggatttattgggcttaaagggtgcgtaggcggcctgttaagtcaggggtgaaagacggtagcttaactatcgcagtgcccttgatactgatgggcttgaatgtactagaggtaggcggaatgtgacaagtagcggtgaaatgcatagatatgtcacagaacaccaattgcgaaggcagcttactatggtatgattgacgctgagacacgaaagcgtgggtagcaaacagg

SEQ ID NO: 1094 - DNA, 253 bp, Unknown
  Description of Unknown: Polynucleotide
  OTU_191; Phylum: Bacteroidetes; Class:  Sphingobacteriia; Order:  Sphingobacteriales
tacggaggatccaagcgttatccggattcattgggtttaaagggtgcgtaggcggaatgataagtcagtggtgaaagcctgcagcttaactgcagaactgccattgatactgtcaatcttgagtacatttgatgtgggcggaatgtgtcatgtagcggtgaaatgcttagatatgacacagaacaccgattgcgaaggcagctcacaaaactgtaactgacgctgaggcacgaaagcgtgggtatcaaacagg

SEQ ID NO: 1095 - DNA, 253 bp, Candidatus Protochlamydia
  OTU_223; Phylum: Chlamydiae; Class:  Chlamydiia; Order:  Chlamydiales; Family:  Parachlamydiaceae
tacggagggtgcaagcattaatcggatttattgggcgtaaagggcgcgtaggcggggatataagtcagatgtgaaatcctggggctcaacctcagaactgcatttgaaactgtatctctagagggtaggaggagaaaacggaattccacaagtagcggtgaaatgcgtagatatgtggaagaacaccggtggcgaaggcggttttctatcttattcctgacgctgaggcgcgaaagcaaggggatcaaacagg

SEQ ID NO: 1096 - DNA, 253 bp, Unknown
  Description of Unknown: Polynucleotide
  OTU_195; Phylum: Chlamydiae; Class:  Chlamydiia; Order:  Chlamydiales
tacggagggtgcaagcattgatcggaattactgggcgtaaagggcgcgtaggcggcctgaaaagtcagatgtgaaattccggggctcaaccccggagctgcatttgaaactttcaggcttgaggttagtaagggaaaacggaattccacgtgtagcggtgaaatgcgtagatatgtggaagaacaccggtggtgaagacggttttctgtgctaaacctgacgctgaggcgcgaaagctaggggagcaaacagg

SEQ ID NO: 1097 - DNA, 253 bp, Unknown
  Description of Unknown: Polynucleotide
  OTU_790; Phylum: Chloroflexi; Class:  Anaerolineae; Order:  SBR1031; Family:  A4b
aacgtaggagacgaacgttatccggagttactgggcgtaaagggcgtgtaggcggtttgttaagtctggcgtgaaagctctcggctaaaccgggagaggtcgttggatactggcaaactagaggatggtagaggcgtgtggaattccgggagtagtggtgaaatgcgtagagatccggaggaacaccagtggcgaaggcgacacgctgggccatacctgacgctaaagcgcgacagcatggggagcaaacggg

SEQ ID NO: 1098 - DNA, 253 bp, Unknown
  Description of Unknown: Polynucleotide
  OTU_103; Phylum: Fibrobacteres; Class:  Fibrobacteria; Order:  258ds10
tacgaggggggcaaatgttgttcggaatcactgggcgtaaagggagcgtaggcgggttcttaagttaggtgtttaatcccggggcccaaccccggaccggcacttaaaactgggaatcttgaatagtggagaggtcggtggaattgggggtgtagcggtggaatgcgtagagatccccaagaacaccagttgcgaaggcggccgactggacacatattgacgctgaggctcgaaagcatggggagcaaacagg

SEQ ID NO: 1099 - DNA, 253 bp, Bacillus coagulans
  OTU_467; Phylum: Firmicutes; Class:  Bacilli; Order:  Bacillales; Family:  Bacillaceae
tacgtaggtggcaagcgttgtccggaattattgggcgtaaagcgcgcgcaggcggcttcttaagtctgatgtgaaatcttgcggctcaaccgcaagcggtcattggaaactgggaggcttgagtgcagaagaggagagtggaattccacgtgtagcggtgaaatgcgtagagatgtggaggaacaccagtggcgaaggcggctctctggtctgtaactgacgctgaggcgcgaaagcgtggggagcaaacagg

SEQ ID NO: 1100 - DNA, 253 bp, Bacillus firmus
  OTU_3; Phylum: Firmicutes; Class:  Bacilli; Order:  Bacillales; Family:  Bacillaceae
tacgtaggtggcaagcgttgtccggaattattgggcgtaaagcgcgcgcaggcggttccttaagtctgatgtgaaagcccccggctcaaccggggagggtcattggaaactggggaacttgagtgcagaagagaagagtggaattccacgtgtagcggtgaaatgcgtagagatgtggaggaacaccagtggcgaaggcgactctttggtctgtaactgacgctgaggcgcgaaagcgtggggagcaaacagg

SEQ ID NO: 1101 - DNA, 253 bp, Bacillus flexus
  OTU_27; Phylum: Firmicutes; Class:  Bacilli; Order:  Bacillales; Family:  Bacillaceae
tacgtaggtggcaagcgttatccggaattattgggcgtaaagcgcgcgcaggcggtttcttaagtctgatgtgaaagcccacggctcaaccgtggagggtcattggaaactggggaacttgagtgcagaagagaaaagcggaattccacgtgtagcggtgaaatgcgtagagatgtggaggaacaccagtggcgaaggcggctttttggtctgtaactgacgctgaggcgcgaaagcgtggggagcaaacagg

SEQ ID NO: 1102 - DNA, 253 bp, Bacillus sp.
  OTU_3473; Phylum: Firmicutes; Class:  Bacilli; Order:  Bacillales; Family:  Bacillaceae
tacgtaggtggcaagcgttgtccggaattattgggcgtaaagcgcgcgcaggcggttccttaagtctgatgtgaaagcccacggctcaaccgttgggggtcattggaaactggggaacttgagtgcagaagaggagagcggaattccacgtgtagcggtgaaatgcgtagagatgtggaggaacaccagtggcgaaggcggctctctggtctgtaactgacgctgaggcgcgaaagcgtggggagcaaacagg

SEQ ID NO: 1103 - DNA, 253 bp, Bacillus sp.
  OTU_131; Phylum: Firmicutes; Class:  Bacilli; Order:  Bacillales; Family:  Bacillaceae
tacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacagg

SEQ ID NO: 1104 - DNA, 253 bp, Geobacillus sp.
  OTU_106; Phylum: Firmicutes; Class:  Bacilli; Order:  Bacillales; Family:  Bacillaceae
tacgtagggggcgagcgttgtccggaattattgggcgtaaagcgcgcgcaggcggtctcttaagtctgatgtgaaagcccacggctcaaccgtggagggtcattggaaactgggggacttgagggcaggagaggagagcggaattccacgtgtagcggtgaaatgcgtagagatgtggaggaacaccagtggcgaaggcggctctctggcctgcacctgacgctgaggcgcgaaagcgtggggagcaaacagg

SEQ ID NO: 1105 - DNA, 252 bp, Paenibacillus sp.
  OTU_6; Phylum: Firmicutes; Class:  Bacilli; Order:  Bacillales; Family:  Paenibacillaceae
tacgtagggggcaagcgttgtccggaattattgggcgtaaagcgcgcgcaggcggctttttaagtccggtgtcacagcccaaggctcaaccttgggtcgcactggaaactggagagcttgagtacagaagaggaaagtggaattccacgtgtagcggtgaaatgcgtagagatgtggaggaacaccagtggcgaaggcgactttctgggctgtaactgacgctgaggcgcgaaagcgtggggagcaaacagg

SEQ ID NO: 1106 - DNA, 253 bp, Unknown
  Description of Unknown: Polynucleotide
  OTU_38; Phylum: Firmicutes; Class:  Bacilli; Order:  Bacillales; Family:  Planococcaceae
tacgtaggtggcaagcgttgtccggaattattgggcgtaaagcgcgcgcaggcggtcctttaagtctgatgtgaaagcccacggctcaaccgtggagggtcattggaaactgggggacttgagtacagaagaggaaagcggaattccacgtgtagcggtgaaatgcgtagagatgtggaggaacaccagtggcgaaggcggctttctggtctgtaactgacgctgaggcgcgaaagcgtggggagcaaacagg

SEQ ID NO: 1107 - DNA, 253 bp, Unknown
  Description of Unknown: Polynucleotide
  OTU_763; Phylum: Firmicutes; Class:  Bacilli; Order:  Bacillales
tacgtaggtggcaagcgttgtccggaattattgggcgtaaagcgcgcgcaggcggcctcctaagtccgatgtgaaagcccacggctcaaccgtggagggtcattggaaactgggggacttgagtgcaggagagaagagtggaattccacgtgtagcggtgaaatgcgtagagatgtggaggaacaccagtggcgaaggcgactctttggcctgtaactgacgctgaggcgcgaaagcgtggggagcaaacagg

SEQ ID NO: 1108 - DNA, 253 bp, Clostridium butyricum
  OTU_9; Phylum: Firmicutes; Class:  Clostridia; Order:  Clostridiales; Family:  Clostridiaceae
tacgtaggtggcaagcgttgtccggatttactgggcgtaaagggagcgtaggtggatatttaagtgggatgtgaaatactcgggcttaacttgagtgctgcattccaaactggatatctagagtgcaggagaggaaagtagaattcctagtgtagcggtgaaatgcgtagagattaggaagaataccagtggcgaaggcgactttctggactgtaactgacactgaggctcgaaagcgtggggagcaaacagg

SEQ ID NO: 1109 - DNA, 252 bp, Unknown
  Description of Unknown: SMB53 polynucleotide sp.
  OTU_1079; Phylum: Firmicutes; Class:  Clostridia; Order:  Clostridiales; Family:  Clostridiaceae
cacgtagggcgcgagcgttaatcggaattactgggcgtaaagggtgcgtaggtggtttcttaagtcagaggtgaaaggctacggctcaaccgtagtaagcctttgaaactgggaaacttgagtgcaggagaggagagtggaattcctagtgtagcggtgaaatgcgtagatattaggaggaacaccagttgcgaaggcggctctctggactgtaactgacactgaggcacgaaagcgtggggagcaaacagg

SEQ ID NO: 1110 - DNA, 253 bp, Thermoanaerobacterium saccharolyticum
  OTU_181; Phylum: Firmicutes; Class:  Clostridia; Order:  Clostridiales; Family:  Clostridiaceae
tacgtagggggcgagcgttgtccggaattactgggcgtaaagagcacgtaggcggctatataagtcaggtgtgaaaaacctgggcttaaccgagggtatgcatctgaaactatatagcttgagtcaaggagaggagagcggaattcctggtgtagcggtgaaatgcgtagagatcaggaagaataccagtggcgaaagcggctctctggacttgaactgacgctgaggtgcgaaagcgtggggagcaaacagg

SEQ ID NO: 1111 - DNA, 253 bp, Caldicellulosiruptor saccharolyticus
  OTU_262; Phylum: Firmicutes; Class:  Clostridia; Order:  Thermoanaerobacterales; Family:  Caldicellulosiruptoraceae
tacgtaggtggcgagcgttgtccggaattactgggcgtaaagggtgcgtaggcggcctggtaagttgagcgtgaaatttttgggctcaacccaaaaggagcgctcaatactgccgggcttgagtgcgggagaggacggcggaattcccggtgtagcggtgaaatgcgtagatatcgggaggaacaccagtggcgaaggcggccgtctggaccgtaactgacgctgaggcacgaaagcgtggggagcaaacagg

SEQ ID NO: 1112 - DNA, 253 bp, Carboxydocella sp.
  OTU_431; Phylum: Firmicutes; Class:  Clostridia; Order:  Thermoanaerobacterales; Family:  Carboxydocellaceae
aacgtagggggcgagcgttatccggaattactgggcgtaaagcgcgtgtaggcgggctgttaagtcggttgtgaaaatccggggctcaactccggacatgcagccgatactgacagtcttgagggcaggagagggaagcggaattcccggtgtagcggtgaaatgcgtagatatcgggaggaacaccagtggcgaaggcggctttctggactgtacctgacgctgagacgcgaaagcgtggggagcaaacagg

SEQ ID NO: 1113 - DNA, 253 bp, Asticcacaulis biprosthecium
  OTU_158; Phylum: Proteobacteria; Class:  Alphaproteobacteria; Order:  Caulobacterales; Family:  Caulobacteraceae
tacgaagggggctagcgttgctcggaattactgggcgtaaagggagcgtaggcgggttatcaagttggaggtgaaagcccagggctcaaccttggaattgccttcaaaactgatagcctagagtatgatagaggtaagtggaactccgagtgtagaggtgaaattcgtagatattcggaagaacaccagtggcgaaggcgacttactggatcatgactgacgctgaggctcgaaagcgtggggagcaaacagg

SEQ ID NO: 1114 - DNA, 253 bp, Caulobacter sp.
  OTU_340; Phylum: Proteobacteria; Class:  Alphaproteobacteria; Order:  Caulobacterales; Family:  Caulobacteraceae
tacgaagggggctagcgttgctcggaattactgggcgtaaagggagcgtaggcggatagtttagtcagaggtgaaagcccagggctcaaccttggaattgcctttgatactggctatcttgagtatggaagaggtatgtggaactccgagtgtagaggtgaaattcgtagatattcggaagaacaccagtggcgaaggcgacatactggtccattactgacgctgaggctcgaaagcgtggggagcaaacagg

SEQ ID NO: 1115 - DNA, 253 bp, Caulobacter sp.
  OTU_157; Phylum: Proteobacteria; Class:  Alphaproteobacteria; Order:  Caulobacterales; Family:  Caulobacteraceae
tacgaagggggctagcgttgctcggaattactgggcgtaaagggagcgtaggcggactgttaagttagaggtgaaagcccagggctcaaccttggaattgcctttgatactggcagtcttgagtacggaagaggtatgtggaactccgagtgtagaggtgaaattcgtagatattcggaagaacaccagtggcgaaggcgacatactggtccgttactgacgctgaggctcgaaagcgtggggagcaaacagg

SEQ ID NO: 1116 - DNA, 253 bp, Mycoplana sp.
  OTU_243; Phylum: Proteobacteria; Class:  Alphaproteobacteria; Order:  Caulobacterales; Family:  Caulobacteraceae
tacgaagggggctagcgttgctcggaattactgggcgtaaagggagcgtaggcggacatttaagtcagaggtgaaatcccggagcttaacttcggaactgcctttgatactgggtgtcttgagtgtgagagaggtatgtggaactccgagtgtagaggtgaaattcgtagatattcggaagaacaccagtggcgaaggcgacatactggctcattactgacgctgaggctcgaaagcgtggggagcaaacagg

SEQ ID NO: 1117 - DNA, 253 bp, Phenylobacterium sp.
  OTU_292; Phylum: Proteobacteria; Class:  Alphaproteobacteria; Order:  Caulobacterales; Family:  Caulobacteraceae
tacgaagggggctagcgttgctcggaattactgggcgtaaagggcgcgtaggcggacagtttagtcagaggtgaaagcccagggctcaaccttggaattgcctttgatactggctgtcttgagttcgggagaggtgagtggaatgccgagtgtagaggtgaaattcgtagatattcggcggaacaccagtggcgaaggcgactcactggcccgatactgacgctgaggcgcgaaagcgtggggagcaaacagg

SEQ ID NO: 1118 - DNA, 253 bp, Unknown
  Description of Unknown: Polynucleotide
  OTU_341; Phylum: Proteobacteria; Class:  Alphaproteobacteria; Order:  Ellin329
tacgaagggggctagcgttgttcggaattactgggcgtaaagcgcgcgcaggcggtcttccaagtcagtggtgaaagcccggagctcaactccggaactgccattgaaactgttggacttgagtatgagagaggtgagtggaattcccagtgtagaggtgaaattcgtagatattgggaagaacaccggtggcgaaggcggctcactggctcattactgacgctcaggcgcgacagcgtggggatcaaacagg

SEQ ID NO: 1119 - DNA, 253 bp, Methylobacterium sp.
  OTU_69; Phylum: Proteobacteria; Class:  Alphaproteobacteria; Order:  Rhizobiales; Family:  Methylobacteriaceae
tacgaagggggctagcgttgctcggaatcactgggcgtaaagggcgcgtaggcggcgttttaagtcgggggtgaaagcctgtggctcaaccacagaatggccttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacagg

SEQ ID NO: 1120 - DNA, 253 bp, Mesorhizobium sp.
  OTU_149; Phylum: Proteobacteria; Class:  Alphaproteobacteria; Order:  Rhizobiales; Family:  Phyllobacteriaceae
tacgaagggggctagcgttgttcggaattactgggcgtaaagcgcacgtaggcggatatttaagtcaggggtgaaatcccggggctcaaccccggaactgcctttgatactgggtatctcgagtccgagagaggtgagtggaattccgagtgtagaggtgaaattcgtagatattcggaggaacaccagtggcgaaggcggctcactggctcggtactgacgctgaggtgcgaaagcgtggggagcaaacagg

SEQ ID NO: 1121 - DNA, 253 bp, Agrobacterium sp.
  OTU_54; Phylum: Proteobacteria; Class:  Alphaproteobacteria; Order:  Rhizobiales; Family:  Rhizobiaceae
tacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattgcgagtgtagaggtgaaattcgtagatattcgcaggaacaccagtggcgaaggcggcttactggtccattactgacgctgaggtgcgaaagcgtggggagcaaacagg

SEQ ID NO: 1122 - DNA, 253 bp, Agrobacterium sp.
  OTU_3736; Phylum: Proteobacteria; Class:  Alphaproteobacteria; Order:  Rhizobiales; Family:  Rhizobiaceae
tacgaagggggctagcgttgttcggatttactgggcgtaaagcgcacgtaggcggacacttaagtcaggggtgaaatcccagagctcaactctggaactgcctttgatactgggtgtttggagtatggaagaggtaagtggaattccgagtgtagaggtgaaattcgtagatattcggaggaacaccagtggcgaaggcggcttactggtccattactgacgctgaggtgcgaaagcgtggggagcaaacagg

SEQ ID NO: 1123 - DNA, 253 bp, Rhizobium sp.
  OTU_174; Phylum: Proteobacteria; Class:  Alphaproteobacteria; Order:  Rhizobiales; Family:  Rhizobiaceae
tacgaagggggctagcgttgttcggatttactgggcgtaaagcgcacgtaggcggatcgatcagtcaggggtgaaatcccagagctcaactctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacagg

SEQ ID NO: 1124 - DNA, 253 bp, Skermanella sp.
  OTU_3518; Phylum: Proteobacteria; Class:  Alphaproteobacteria; Order:  Rhodospirillales; Family:  Rhodospirillaceae
tacgaaggaggctagcgttgttcggaattactgggcgtaaagggcgcgtaggcggtccctcaagtcaggcgtgaaagccccgggctcaacctgggaaccgcgcttgagactgatgggctagagttcgggagaggatggtggaattcccagtgtagaggtgaaattcgtagatattggaaagaacaccgatggcgaaggcagccatctggaccgacactgacgctgaggcgcgaaagcgtggggagcaaacagg

SEQ ID NO: 1125 - DNA, 253 bp, Unknown
  Description of Unknown: Polynucleotide
  OTU_245; Phylum: Proteobacteria; Class:  Alphaproteobacteria; Order:  Rhodospirillales; Family:  Rhodospirillaceae
tacgaagggggcgagcgttgttcggaattactgggcgtaaagggcgcgtaggcggcgacccaagtcagatgtgaaagtcctgggcttaacctggggactgcatttgatactgggttgcttgaattcgggagaggatagcggaattcccagtgtagaggtgaaattcgtagatattgggaagaacaccggtggcgaaggcggctatctggaccgacattgacgctgaggcgcgaaagcgtggggagcaaacagg

SEQ ID NO: 1126 - DNA, 253 bp, Unknown
  Description of Unknown: Polynucleotide
  OTU_289; Phylum: Proteobacteria; Class:  Alphaproteobacteria; Order:  Rhodospirillales; Family:  Rhodospirillaceae
tacgaagggggcaagcgttgttcggaattactgggcgtaaagggcgcgtaggcggcttatcaagtcaggcgtgaaattcccgggctcaacctgggggctgcgcttgatactgatgagcttgaatgcgggagaggatagtggaattcccagtgtagaggtgaaattcgtagatattgggaagaacaccggtggcgaaggcggctatctggcccgtaattgacgctgaggcgcgaaagcgtggggagcaaacagg

SEQ ID NO: 1127 - DNA, 253 bp, Unknown
  Description of Unknown: Polynucleotide
  OTU_242; Phylum: Proteobacteria; Class:  Alphaproteobacteria; Order:  Rickettsiales
gacggagggggctagcgttgttcggaatgactgggcgtaaagggcgcgtaggcggttttttaagtgaggcgtgaaagccctgggcttaacctaggaggtgcgtttcatactggaagacttgagtacgagagaggaaagcggaattcctagtgtagaggtgaaattcgtagatattaggaagaacaccagtggcgaaggcggctttctggctcgtaactgacgctgaggcgcgaaagcgtggggagcaaacagg

SEQ ID NO: 1128 - DNA, 253 bp, Unknown
  Description of Unknown: Polynucleotide
  OTU_185; Phylum: Proteobacteria; Class:  Alphaproteobacteria; Order:  Sphingomonadales; Family:  Erythrobacteraceae
tacggagggagctagcgttgttcggaaatactgggcgtaaagcgcacgtaggcggcgcagcaagtcaggggtgaaatcccggggctcaaccccggaactgcctctgaaactgcagtgctagaatcttggagaggcgagtggaattccgagtgtagaggtgaaattcgtagatattcggaagaacaccagtggcgaaggcgactcgctggacaagtattgacgctgaggtgcgaaagcgtggggagcaaacagg

SEQ ID NO: 1129 - DNA, 253 bp, Kaistobacter sp.
  OTU_184; Phylum: Proteobacteria; Class:  Alphaproteobacteria; Order:  Sphingomonadales; Family:  Sphingomonadaceae
tacggagggggctagcgttgttcggaattactgggcgtaaagcgcacgtaggcggctttgtaagttagaggtgaaagcccggggctcaactccggaattgcctttaagactgcatcgctagaattgtggagaggtaagtggaattccgagtgtagaggtgaaattcgtagatattcggaagaacaccagtggcgaaggcgacttactggacacatattgacgctgaggtgcgaaagcgtggggagcaaacagg

SEQ ID NO: 1130 - DNA, 253 bp, Kaistobacter sp.
  OTU_304; Phylum: Proteobacteria; Class:  Alphaproteobacteria; Order:  Sphingomonadales; Family:  Sphingomonadaceae
tacggagggggctagcgttgttcggaattactgggcgtaaagcgcacgtaggcggctttgtaagttagaggtgaaagcccggggctcaactccggaattgcctttaagactgcatcgctcgaacgtcggagaggtaagtggaattccgagtgtagaggtgaaattcgtagatattcggaagaacaccagtggcgaaggcgacttactggacgattgttgacgctgaggtgcgaaagcgtggggagcaaacagg

SEQ ID NO: 1131 - DNA, 253 bp, Sphingomonas echinoides
  OTU_568; Phylum: Proteobacteria; Class:  Alphaproteobacteria; Order:  Sphingomonadales; Family:  Sphingomonadaceae
tacggagggagctagcgttattcggaattactgggcgtaaagcgcacgtaggcggctttgtaagtaaggggtgaaagcctggtgctcaacaccagaactgccctttagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacagg

SEQ ID NO: 1132 - DNA, 253 bp, Sphingomonas yabuuchiae
  OTU_23; Phylum: Proteobacteria; Class:  Alphaproteobacteria; Order:  Sphingomonadales; Family:  Sphingomonadaceae
tacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacagg

SEQ ID NO: 1133 - DNA, 253 bp, Sphingomonas sp.
  OTU_3351; Phylum: Proteobacteria; Class:  Alphaproteobacteria; Order:  Sphingomonadales; Family:  Sphingomonadaceae
tacggagggagctagcgttgttcggaattactgggcgtaaagcgcacgtaggcggttttgtaagtcagaggtgaaagcctggagctcaactccagaactgcctttaaaactgcatcgcttgaatccaggagaggtgagtggaattctgagtgtagaggtgaaattcgtagatattcggaagaacaccagtggcgaaggcggctcactggactggtattgacgctgaggtgcgaaagcgtggggagtaaacagg

SEQ ID NO: 1134 - DNA, 253 bp, Sphingomonas sp.
  OTU_383; Phylum: Proteobacteria; Class:  Alphaproteobacteria; Order:  Sphingomonadales; Family:  Sphingomonadaceae
tacggagggagctagcgttgttcggaattactgggcgtaaagcgcacgtaggcggctttgtaagttaggggtgaaagcctggagctcaacttcagaattgcccttaagactgcatcgcttgaatccaggagaggtgagtggaactccgagtgtagaggtgaaattcgtagatattcggaagaacaccagtggcgaaggcggctcactggactggtattgacgctgaggtgcgaaagcgtggggagcaaacagg

SEQ ID NO: 1135 - DNA, 253 bp, Sphingomonas sp.
  OTU_78; Phylum: Proteobacteria; Class:  Alphaproteobacteria; Order:  Sphingomonadales; Family:  Sphingomonadaceae
tacggagggagctagcgttattcggaattactgggcgtaaagcgcacgtaggcggctttgtaagtaagaggtgaaagcccagagctcaactctggaattgccttttagactgcatcgcttgaatcatggagaggtcagtggaattccgagtgtagaggtgaaattcgtagatattcggaagaacaccagtggcgaaggcggctgactggacatgtattgacgctgaggtgcgaaagcgtggggagcaaacagg

SEQ ID NO: 1136 - DNA, 253 bp, Sphingomonas sp.
  OTU_3439; Phylum: Proteobacteria; Class:  Alphaproteobacteria; Order:  Sphingomonadales; Family:  Sphingomonadaceae
tacggagggggctagcgttgttcggaattactgggcgtcaagcgcacctaggcggctttgtaagttagaggtgaaagcctggggctcaactctagaactgcctttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacagg

SEQ ID NO: 1137 - DNA, 253 bp, Sphingopyxis alaskensis
  OTU_93; Phylum: Proteobacteria; Class:  Alphaproteobacteria; Order:  Sphingomonadales; Family:  Sphingomonadaceae
tacggagggagctagcgttgttcggaattactgggcgtaaagcgcgcgtaggcggttttttaagtcagaggtgaaagcccagtgctcaacactggaactgcctttgaaactggaaaacttgaatcttggagaggtcagtggaattccgagtgtagaggtgaaattcgtagatattcggaagaacaccagtggcgaaggcgactgactggacaagtattgacgctgaggtgcgaaagcgtggggagcaaacagg

SEQ ID NO: 1138 - DNA, 253 bp, Achromobacter sp.
  OTU_199; Phylum: Proteobacteria; Class:  Betaproteobacteria; Order:  Burkholderiales; Family:  Alcaligenaceae
tacgtagggtgcaagcgttaatcggaattactgggcgtaaagcgtgcgcaggcggttcggaaagaaagatgtgaaatcccagagcttaactttggaactgcatttttaactaccgagctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacagg

SEQ ID NO: 1139 - DNA, 253 bp, Burkholderia sp.
  OTU_18; Phylum: Proteobacteria; Class:  Betaproteobacteria; Order:  Burkholderiales; Family:  Burkholderiaceae
tacgtagggtgcgagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacagg

SEQ ID NO: 1140 - DNA, 253 bp, Burkholderia sp.
  OTU_639; Phylum: Proteobacteria; Class:  Betaproteobacteria; Order:  Burkholderiales; Family:  Burkholderiaceae
tacgtagggtgcaagcgttaatcggaattactgggcgtaaagcgtgcgcaggcggtccgttaagacagatgtgaaatccccgggcttaacctgggaactgcatttgtgactggcggactcgagtatggcagaggggggtagaattccacgtgtagcagtgaaatgcgtagagatgtggaggaataccgatggcgaaggcagccccctgggccaatactgacgctcatgcacgaaagcgtggggagcaaacagg

SEQ ID NO: 1141 - DNA, 253 bp, Burkholderia sp.
  OTU_2905; Phylum: Proteobacteria; Class:  Betaproteobacteria; Order:  Burkholderiales; Family:  Burkholderiaceae
tacgtagggtgcgagcgttaattggaattactgggcgtaaagcgtgcgcaggcggtctgttaagaccgatgtgaaatccccgggcttaacctgggaactgcattggtgactggcaggctagagtgtggcagagggaggtagaattccacgtgtagcagtgaaatgcgtagagatgtggaggaataccgatggcgaaggcagcctcctgggccaacactgacgctcatgcacgaaagcgtggggagcaaacagg

SEQ ID NO: 1142 - DNA, 253 bp, Delftia sp.
  OTU_64; Phylum: Proteobacteria; Class:  Betaproteobacteria; Order:  Burkholderiales; Family:  Comamonadaceae
tacgtagggtgcgagcgttaatcggaattactgggcgtaaagcgtgcgcaggcggttatgtaagacagatgtgaaatccccgggctcaacctgggaactgcatttgtgactgcatggctagagtacggtagagggggatggaattccgcgtgtagcagtgaaatgcgtagatatgcggaggaacaccgatggcgaaggcaatcccctggacctgtactgacgctcatgcacgaaagcgtggggagcaaacagg

SEQ ID NO: 1143 - DNA, 253 bp, Hylemonella sp.
  OTU_283; Phylum: Proteobacteria; Class:  Betaproteobacteria; Order:  Burkholderiales; Family:  Comamonadaceae
tacgtagggtgcaagcgttaatcggaattactgggcgtaaagcgtgcgcaggcggtgatgtaagacagttgtgaaatccccgggctcaacctgggaactgcatctgtgactgcatcgctggagtacggcagagggggatggaattccgcgtgtagcagtgaaatgcgtagatatgcggaggaacaccgatggcgaaggcaatcccctgggcctgtactgacgctcatgcacgaaagcgtggggagcaaacagg

SEQ ID NO: 1144 - DNA, 253 bp, Methylibium sp.
  OTU_215; Phylum: Proteobacteria; Class:  Betaproteobacteria; Order:  Burkholderiales; Family:  Comamonadaceae
tacgtagggtgcaagcgttaatcggaattactgggcgtaaagcgtgcgcaggcggctttgcaagacagatgtgaaatccccgggcttaacctgggaactgcatttgtgactgcatggctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacagg

SEQ ID NO: 1145 - DNA, 253 bp, Polaromonas sp.
  OTU_3641; Phylum: Proteobacteria; Class:  Betaproteobacteria; Order:  Burkholderiales; Family:  Comamonadaceae
tacgtagggtgcgagcgttaatcggaattactgggcgtaaagcgtgcgcaggcggttatataagacagttgtgaaatccccggggtcaacctgggaattgcatctgtgactgtatagctagagtacggtagagggggatggaattccgcgagtagcagtgaaatgcgtagatatgcggaggaacaccgatggcgaaggcagtcccctggacctgtactgacgctcatgcacgaaagcgtggggagcaaacagg

SEQ ID NO: 1146 - DNA, 253 bp, Variovorax paradoxus
  OTU_3253; Phylum: Proteobacteria; Class:  Betaproteobacteria; Order:  Burkholderiales; Family:  Comamonadaceae
tacgtagggcgcaagcgttaatcggaattactgggcgtaaagcgtgcgcaggcggttatgtaagacagttgtgaaatccccgggctcaacctgggaactgcatctgtgactgcatagctagagtacggtagagggggatggaattccgcgagtagtagtgaaatgcgtagatatgcggaggaacaccgatggcgaaggcaatcccctggacctgtactgatgctcatgcacgaaagcgtggggagcaaacagg

SEQ ID NO: 1147 - DNA, 253 bp, Variovorax sp.
  OTU_3420; Phylum: Proteobacteria; Class:  Betaproteobacteria; Order:  Burkholderiales; Family:  Comamonadaceae
tacggaggatccaagcgttaatcggaattactgggcgtaaagcgtgcgcaggcggtgatgtaagacagatgtgaaacccccgggctcaacctgggaactgcatttgtgactgcatcgctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacagg

SEQ ID NO: 1148 - DNA, 253 bp, Unknown
  Description of Unknown: Polynucleotide
  OTU_236; Phylum: Proteobacteria; Class:  Betaproteobacteria; Order:  Burkholderiales; Family:  Comamonadaceae
tacgtagggtgcgagcgttaatcggaattactgggcgtaaagcgtgcgcaggcggctttgcaagacagaggtgaaatccccgggctcaacctgggaactgcctttgtgactgcaaggctagagtacggcagagggggatggaattccgcgtgtagcagtgaaatgcgtagatatgcggaggaacaccgatggcgaaggcaatcccctgggcctgtactgacgctcatgcacgaaagcgtggggagcaaacagg

SEQ ID NO: 1149 - DNA, 253 bp, Unknown
  Description of Unknown: Polynucleotide
  OTU_222; Phylum: Proteobacteria; Class:  Betaproteobacteria; Order:  Burkholderiales; Family:  Comamonadaceae
tacgtagggtgcaagcgttaatcggaattactgggcgtaaagcgtgcgcaggcggttctataagacagatgtgaaatccccgggctcaacctgggaactgcatttgtgactgtagagctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacagg

SEQ ID NO: 1150 - DNA, 253 bp, Unknown
  Description of Unknown: Polynucleotide
  OTU_2922; Phylum: Proteobacteria; Class:  Betaproteobacteria; Order:  Burkholderiales; Family:  Comamonadaceae
tacgtagggtgcaagcgttaatcggaattactgggcgtaaagcgtgcgcaggcggtgatgtaagacaggtgtgaaatccccgggcttaacctgggaactgcatttgtgactgcatcgctggagtgcggcagagggggatggaattccgcgtgtagcagtgaaatgcgtagatatgcggaggaacaccgatggcgaaggcaattttctgggcctgcactgacgctcatgcacgaaagcgtggggagcaaacagg

SEQ ID NO: 1151 - DNA, 253 bp, Unknown
  Description of Unknown: Polynucleotide
  OTU_3580; Phylum: Proteobacteria; Class:  Betaproteobacteria; Order:  Burkholderiales; Family:  Comamonadaceae
tacgtagggtgcaagcgttaatcggaattactgggcgtaaagcgtgcgcaggcggttatgcaagacagaggtgaaatccccggggtcaacctgggaactgcctttgtgactgcatagctagagtgcggcagagggggatggaattccgcgagtagcagtgaaatgcgtagatatgcggaggaacaccgatggcgaaggcaatcccctgggcctgcactgacgctcatgcacgaaagcgtggggagcaaacagg

SEQ ID NO: 1152 - DNA, 253 bp, Unknown
  Description of Unknown: Polynucleotide
  OTU_443; Phylum: Proteobacteria; Class:  Betaproteobacteria; Order:  Burkholderiales; Family:  Comamonadaceae
tacgtagggtgcaagcgttaatcggaattactgggcgtaaagcgtgcgcaggcggtcttgtaagacagaggtgaaatccccgggcttaacctgggaactgcctttgtgactgcaaggcttgagtgcggcagagggggatggaattccgcgtgtagcagtgaaatgcgtagatatgcggaggaacaccgatggcgaaggcaatcccctgggcctgcactgacgctcatgcacgaaggcgtggggagcaaacagg

SEQ ID NO: 1153 - DNA, 253 bp, Unknown
  Description of Unknown: Polynucleotide
  OTU_2585; Phylum: Proteobacteria; Class:  Betaproteobacteria; Order:  Burkholderiales; Family:  Comamonadaceae
tacgtagggtgcaagcgttaatcggaattactgggcgtaaagcgtgcgcaggcggttgtgcaagacagatgtgaaatccccgggctcaacttgggaactgcatttgtgactgcacggctagagtgcggcagagggagatggaattccgcgtgtagcagtgaaatgcgtagatatgcggaggaacaccgatggcgaaggcaatctcctgggcctgcactgacgctcatgcacgaaagcgtggggagcaaacagg

SEQ ID NO: 1154 - DNA, 253 bp, Herbaspirillum sp.
  OTU_50; Phylum: Proteobacteria; Class:  Betaproteobacteria; Order:  Burkholderiales; Family:  Oxalobacteraceae
tacgtagggtgcaagcgttaatcggaattactgggcgtaaagcgtgcgcaggcggttgtgtaagtcagatgtgaaatccccgggctcaacctgggaattgcatttgagactgcacggctagagtgtgtcagaggggggtagaattccacgtgtagcagtgaaatgcgtagatatgtggaggaataccgatggcgaaggcagccccctgggataacactgacgctcatgcacgaaagcgtggggagcaaacagg

SEQ ID NO: 1155 - DNA, 253 bp, Janthinobacterium lividum
  OTU_3392; Phylum: Proteobacteria; Class:  Betaproteobacteria; Order:  Burkholderiales; Family:  Oxalobacteraceae
tacgtagggtgcaagcgttaatcggaattactgggcgtaaagcgtgcgcaggcggttttgtaagtctgatgtgaactccccgggctcaacctgggaattgcactggagactgcaaggctagaatctggcagaggggggtagaattccacgtgtagcagtgaaatgcgtagatatgtggaggaacaccgatggcgaaggcagccccctgggtcaagattgacgctcatgcacgaaagcgtggggagcaaacagg

SEQ ID NO: 1156 - DNA, 253 bp, Janthinobacterium sp.
  OTU_156; Phylum: Proteobacteria; Class:  Betaproteobacteria; Order:  Burkholderiales; Family:  Oxalobacteraceae
tacgtagggtgcaagcgttaatcggaattactgggcgtaaagcgtgcgcaggcggttttgtaagactgtcgtgaaatccccgggctcaacctgggaatggcgatggtgactgcaaggctagagtttggcagaggggggtagaattccacgtgtagcagtgaaatgcgtagatatgtggaggaacaccgatggcgaaggcagccccctgggtcaaaactgacgctcatgcacgaaagcgtggggagcaaacagg

SEQ ID NO: 1157 - DNA, 253 bp, Janthinobacterium sp.
  OTU_3582; Phylum: Proteobacteria; Class:  Betaproteobacteria; Order:  Burkholderiales; Family:  Oxalobacteraceae
tacgtagggtgcaagcgttaatcggaattactgggcgtaaagcgtgcgcgggcggttttgtaggtctgtcgtgaaatccccgggctcaacctgggaattgcggtggggactgcaaggctagaatctggcagagggggggagaattccacgtgtagcagtgaaatgcgtagagatgtggaggaacaccgatggcgaaggcagccccctgggtcaagattgacgctcatgcacgaaagcgtggggagcaaacagg

SEQ ID NO: 1158 - DNA, 253 bp, Janthinobacterium sp.
  OTU_315; Phylum: Proteobacteria; Class:  Betaproteobacteria; Order:  Burkholderiales; Family:  Oxalobacteraceae
tacgtagggtgcaagcgttaatcggaattactgggcgtaaagcgtgcgcaggcggttttgtaagtttgtcgtgaaatccccgggctcaacctgggaatggcgatgaagactgcaaggctagaatctggcagaggggggtagaattccacgtgtagcagtgaaatgcgtagagatgtggaggaacaccgatggcgaaggcagccccctgggtcaagattgacgctcatgcacgaaagcgtggggagcaaacagg

SEQ ID NO: 1159 - DNA, 253 bp, Janthinobacterium sp.
  OTU_2266; Phylum: Proteobacteria; Class:  Betaproteobacteria; Order:  Burkholderiales; Family:  Oxalobacteraceae
tacgaggggggcaagtgttgttcggaattactgggcgtaaagcgtgcgcaggcggttttgtaagtctgtcgtgaaatccccgggctcaacctgggaattgcgatggagactgcaaggctagaatctggcagaggggggtagaattccacgtgtagcagtgaaatgcgtagagatgtggaggaacaccgatggcgaaggcagccccctgggtcaagattgacgctcatgcacgaaagcgtggggagcaaacagg

SEQ ID NO: 1160 - DNA, 253 bp, Massilia haematophila
  OTU_2954; Phylum: Proteobacteria; Class:  Betaproteobacteria; Order:  Burkholderiales; Family:  Oxalobacteraceae
gacggggggggcaagtgttaatcggaattactgggcgtaaagcgtgcgcaggcggttttgtaagtctgacgtgaaagccccgggctcaacctgggaattgcgttggagactgcaaggcttgaatctggcagaggggggtagaattccacgtgtagcagtgaaatgcgtagagatgtggaggaacaccgatggcgaaggcagccccctgggtcaagattgacgctcatgcacgaaagcgtggggagcaaacagg

SEQ ID NO: 1161 - DNA, 253 bp, Massilia sp.
  OTU_2344; Phylum: Proteobacteria; Class:  Betaproteobacteria; Order:  Burkholderiales; Family:  Oxalobacteraceae
tacgtagggtgcaagcgttaatcggaattactgggcgtaaagcgtgcgcaggcggttttgtaagtctgtcgtgaaagccccgggcttaacctgtgaattgcgatggagactgcaaggcttgaatctggcagaggggggtagaattccacgtgtagcagtgaaatgcgtagagatgtggaggaacaccgatggcgaaggcagccccctgggtcaagattgacgctcatgcacgaaagcgtggggggcaaacagg

SEQ ID NO: 1162 - DNA, 253 bp, Ralstonia sp.
  OTU_58; Phylum: Proteobacteria; Class:  Betaproteobacteria; Order:  Burkholderiales; Family:  Oxalobacteraceae
tacgtagggtccaagcgttaatcggaattactgggcgtaaagcgtgcgcaggcggttgtgcaagaccgatgtgaaatccccgggcttaacctgggaattgcattggtgactgcacggctagagtgtgtcagaggggggtagaattccacgtgtagcagtgaaatgcgtagagatgtggaggaataccgatggcgaaggcagccccctgggataacactgacgctcatgcacgaaagcgtggggagcaaacagg

SEQ ID NO: 1163 - DNA, 253 bp, Unknown
  Description of Unknown: Polynucleotide
  OTU_15; Phylum: Proteobacteria; Class:  Betaproteobacteria; Order:  Burkholderiales; Family:  Oxalobacteraceae
tacgtagggtgcaagcgttaatcggaattactgggcgtaaagcgtgcgcaggcggttttgtaagtctgacgtgaaatccccgggctcaacctgggaattgcgttggagactgcaaggctggagtctggcagaggggggtagaattccacgtgtagcagtgaaatgcgtagagatgtggaggaacaccgatggcgaaggcagccccctgggtcaagactgacgctcatgcacgaaagcgtggggagcaaacagg

SEQ ID NO: 1164 - DNA, 253 bp, Unknown
  Description of Unknown: Polynucleotide
  OTU_221; Phylum: Proteobacteria; Class:  Betaproteobacteria; Order:  Burkholderiales; Family:  Oxalobacteraceae
tacgtagggtgcaagcgttaatcggaattactgggcgtaaagcgtgcgcaggcggtttggtaagacagatgtgaaatccccgggcttaacctgggaattgcatttgtgactgcccggctagagtttggcagaggggggtagaattccacgtgtagcagtgaaatgcgtagatatgtggaggaataccgatggcgaaggcagccccctgggtcaagactgacgctcatgcacgaaagcgtggggagcaaacagg

SEQ ID NO: 1165 - DNA, 253 bp, Unknown
  Description of Unknown: Polynucleotide
  OTU_2199; Phylum: Proteobacteria; Class:  Betaproteobacteria; Order:  Burkholderiales; Family:  Oxalobacteraceae
tacgtagggtgcaagcgttaatcggaattactgggcgtaaagcgtgcgcaggcggttttgtaagtctgtcgtgaaatccccgggctcaacctgggaattgcgatggagactgcaaggctagaatatgtcagaggggggtagaattccacgtgtagcagtgaaatgcgtagagatgtggaggaataccaatggcgaaggcagccccctgggtcaagactgacgctcatgcacgaaagcgtggggagcaaacagg

SEQ ID NO: 1166 - DNA, 253 bp, Unknown
  Description of Unknown: Polynucleotide
  OTU_1776; Phylum: Proteobacteria; Class:  Betaproteobacteria; Order:  Ellin6067
tacgtagggtgcaagcgttaatcggaattactgggcgtaaagcgtgcgcaggcggttttgtaagccagatgtgaaatccccgggcttaacctgggaatggcatttgggactgcaaggctggagtttggcagaggagactggaattcctggtgtagcagtgaaatgcgtagatatcaggaggaataccgatggcgaaggcaggtctctgggctataactgacgctcatgcacgaaagcgtggggagcaaacagg

SEQ ID NO: 1167 - DNA, 253 bp, Unknown
  Description of Unknown: Polynucleotide
  OTU_507; Phylum: Proteobacteria; Class:  Betaproteobacteria; Order:  Ellin6067
tacgtagggtgcgagcgttaatcggaattactgggcgtaaagcgtgcgcaggcggttttgtaagccagatgtgaaagccccgggcttaacctgggaatggcatttgggactgcaaggcttgagtgcggcagaggagactggaattcctggtgtagcagtgaaatgcgtagatatcaggaggaataccgatggcgaaggcaggtctctgggctgacactgacgctcatgcacgaaagcgtggggagcaaacagg

SEQ ID NO: 1168 - DNA, 253 bp, Methylotenera mobilis
  OTU_176; Phylum: Proteobacteria; Class:  Betaproteobacteria; Order:  Methylophilales; Family:  Methylophilaceae
tacgtagggtgcgagcgttaatcggaattactgggcgtaaagcgtgcgcaggctgttctgtaagtcagatgtgaaatccccgagctcaacttgggaactgcgtttgaaactacaggactagaatatgtcagaggggggtagaattccacgtgtagcagtgaaatgcgtagagatgtggaggaataccaatggcgaaggcagccccctgggataatattgacgctcatgcacgaaagcgtggggagcaaacagg

SEQ ID NO: 1169 - DNA, 253 bp, Unknown
  Description of Unknown: Polynucleotide
  OTU_115; Phylum: Proteobacteria; Class:  Deltaproteobacteria; Order:  Myxococcales
gacagagggtgcaaacgttgttcggaattactgggcgtaaagcgcgtgtaggcggctctgcaagtcggatgtgaaatcccacggctcaaccatggaagtgcattcgaaactgcagggctagagtcctggagaggaaggtggaatgcttggtgtagaggtgaaattcgtagatatcaagcggaacaccggtggcgaaggcggccttctggacagtgactgacgctgagacgcgaaagcgtggggagcaaacagg

SEQ ID NO: 1170 - DNA, 252 bp, Unknown
  Description of Unknown: Polynucleotide
  OTU_3227; Phylum: Proteobacteria; Class:  Deltaproteobacteria; Order:  Myxococcales
gacagagggtgcaaacgttgttcggaattactgggcgtaaagcgcgtgtaggcggcttcgcaagtcgggtgtgaaatcccacggctcaaccgtggaagtgcactcgagactgcaaggctagagtcctggagaggaaggtggaatgcttggtgtagaggtgaaattcgtagatatcaagcggaacaccggtggcgaaggcggccttctggacagtgactgacgctgagacgcgaaagcgtgggagcaaacagg

SEQ ID NO: 1171 - DNA, 253 bp, Unknown
  Description of Unknown: Polynucleotide
  OTU_165; Phylum: Proteobacteria; Class:  Deltaproteobacteria; Order:  Syntrophobacterales; Family:  Syntrophobacteraceae
gacggagggtgcaagcgttgttcggattgactgggcgtaaagggcgtgtaggcggttgcccaagtccgatgtgaaagcccgaggcctaccctcggaagtgcatcggaaactaggcagctggagcgcgatagaggagggtagaattcctggagtagcggtgaaatgcgtagatatcaggaggaataccggcggcgaaggcggccctctggatcgttgctgacgctgagacgcgaaagcgtggggagcaaacagg

SEQ ID NO: 1172 - DNA, 253 bp, Cellvibrio sp.
  OTU_52; Phylum: Proteobacteria; Class:  Gammaproteobacteria; Order:  Alteromonadales; Family:  Alteromonadaceae
tacggagggtgcaagcgttaatcggaattactgggcgtaaagcgcacgtaggtggtttgttaagctagctgtgaaatccccgggctcaacctgggcactgcagttagaactggcaagctagagtagggtagaggggtgtggaattccaggtgtagcggtgaaatgcgtagatatctggaggaacatcagtggcgaaggcgacaccctggactcatactgacactgaggtgcgaaagcgtggggagcaaacagg

SEQ ID NO: 1173 - DNA, 253 bp, Unknown
  Description of Unknown: Polynucleotide
  OTU_146; Phylum: Proteobacteria; Class:  Gammaproteobacteria; Order:  Alteromonadales; Family:  Alteromonadaceae
tacggagggtgcaagcgttaatcggaattactgggcgtaaagcgcgcgtaggcggccatttaagctagatgtgaaagcccagggcttaaccttggaactgcatttagaactggatggctagagtatggaagaggagtgtggaatttcaggtgtagcggtgaaatgcgtagagatctgaaggaacatcagtggcgaaggcgacactctggtccaatactgacgctgaggtgcgaaagcgtggggatcaaacagg

SEQ ID NO: 1174 - DNA, 253 bp, Enterobacter hormaechei
  OTU_1384; Phylum: Proteobacteria; Class:  Gammaproteobacteria; Order:  Enterobacteriales; Family:  Enterobacteriaceae
tacgtagggtgcgagcgttaatcggaattactgggcgtaaagcgcacgcaggcggtctgtcaagtcggatgtgaaatccccgggctcaacctgggaactgcattcgaaactgacaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacagg

SEQ ID NO: 1175 - DNA, 253 bp, Enterobacter sp.
  OTU_35; Phylum: Proteobacteria; Class:  Gammaproteobacteria; Order:  Enterobacteriales; Family:  Enterobacteriaceae
tacggagggtgcaagcgttaatcggaattactgggcgtaaagcgcacgcaggcggtctgtcaagtcggatgtgaaatccccgggctcaacctgggaactgcatccgaaactggcaggcttgagtctcgtagaggggggtagaattccaggagtagcggtgaaatgcgtagagatctggaggaataccggtggcgaaggcggccccctggacgaagactgacgctcaggtgcgaaagcgtggggagcaaacagg

SEQ ID NO: 1176 - DNA, 254 bp, Erwinia sp.
  OTU_2912; Phylum: Proteobacteria; Class:  Gammaproteobacteria; Order:  Enterobacteriales; Family:  Enterobacteriaceae
gacgggggggtgcaagcgttaatcggaattactgggcgtaaagcgcacgcaggcggtctgtcaagtcggatgtgaaatccccgggcttaacctgggaactgcattcgaaactggcaggctggagtcttgtagaggggggtagaattccaggtgtagcggtgaaatgcgtagagatctggaggaataccggtggcgaaggcggccccctggacaaagactgacgctcaggtgcgaaagcgtggggagcaaacagg

SEQ ID NO: 1177 - DNA, 253 bp, Escherichia coli
  OTU_319; Phylum: Proteobacteria; Class:  Gammaproteobacteria; Order:  Enterobacteriales; Family:  Enterobacteriaceae
tacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgatgctcaggtgcgaaagcgtggggagcaaacagg

SEQ ID NO: 1178 - DNA, 253 bp, Pantoea agglomerans
  OTU_2; Phylum: Proteobacteria; Class:  Gammaproteobacteria; Order:  Enterobacteriales; Family:  Enterobacteriaceae
tacggagggtgcaagcgttaatcggaattactgggcgtaaagcgcacgcaggcggtctgttaagtcagatgtgaaatccccgggcttaacctgggaactgcatttgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacagg

SEQ ID NO: 1179 - DNA, 253 bp, Pantoea ananatis
  OTU_1255; Phylum: Proteobacteria; Class:  Gammaproteobacteria; Order:  Enterobacteriales; Family:  Enterobacteriaceae
gacggggggggcaagtgttcttcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacagg

SEQ ID NO: 1180 - DNA, 253 bp, Pantoea sp.
  OTU_3489; Phylum: Proteobacteria; Class:  Gammaproteobacteria; Order:  Enterobacteriales; Family:  Enterobacteriaceae
tacggagggtgcaagcgttaatcggaattactgggcgtaaagcacacgcaggcggtctgttaagtcagatgtgaaatccccgggcttaacctgggaactgcatttgaaactggcaggcttgagcctcgtagaggggggtagaattccaggtgtagcggtgaaatgcgtagggatctggaggaataccggtggcgaaggcggccccctggacgaagactgacgctcaggtgcgaaagcgtggggagcgaacaac

SEQ ID NO: 1181 - DNA, 253 bp, Unknown
  Description of Unknown: Polynucleotide
  OTU_2970; Phylum: Proteobacteria; Class:  Gammaproteobacteria; Order:  Enterobacteriales; Family:  Enterobacteriaceae
tacggagggtgcaagcgttaatcggaattactgggcgtaaagcgcacgcaggcggtctgtcaagtcggatgtgaaatccccgggctcaacctgggaactgcattcgaaactggcaggcttgagtcttgtagaggggggtagaattccaggtgtagcggtgaaatgcgtagagatgtgggggaacaccgatggcgaaggcggccccctggacaaagactgacgctcaggtgcgaaagcgtggggagcaaacagg

SEQ ID NO: 1182 - DNA, 252 bp, Unknown
  Description of Unknown: Polynucleotide
  OTU_3078; Phylum: Proteobacteria; Class:  Gammaproteobacteria; Order:  Enterobacteriales; Family:  Enterobacteriaceae
tacggagggtgcaagcgttaatcggaattactgggcgtaaaacgcacgcaggcggtttgttaagtcagatgtgaaatccccgagcttaacttgggaactgcatttgaaactggcaagctagagtcttgtagaggggggtagaattccaggtgtagcggtgaaatgcgtagagatctggaggagtaccggtggcgaaggcggccccctggacaaagactgacgccaggtgcgaaagcgtggggagcaaacagg

SEQ ID NO: 1183 - DNA, 253 bp, Unknown
  Description of Unknown: Polynucleotide
  OTU_3153; Phylum: Proteobacteria; Class:  Gammaproteobacteria; Order:  Enterobacteriales; Family:  Enterobacteriaceae
tacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggggaaaggaggagagatctggaggaagaccgggggcgaaggcggccccctggacaaagactgacgctcaggtgcgaaagcgtggggagcaaacagg

SEQ ID NO: 1184 - DNA, 253 bp, Aquicella sp.
  OTU_145; Phylum: Proteobacteria; Class:  Gammaproteobacteria; Order:  Legionellales; Family:  Coxiellaceae
tacagagggtgcgagcgttaatcggagttactgggcgtaaagggcgcgtaggcggtaatatgagtgtggtgtgaaagccccgggcttaacctgggaagtgcatcgcaaacgatataactagagtagatgagagggtggcggaatttccggtgtagcggtgaaatgcgtagagatcggaaggaacgtcaatggcgaaggcagccacctggcatcatactgacgctgaggcgcgaaagcgtggggagcgaacagg

SEQ ID NO: 1185 - DNA, 253 bp, Aquicella sp.
  OTU_379; Phylum: Proteobacteria; Class:  Gammaproteobacteria; Order:  Legionellales; Family:  Coxiellaceae
tacagagggtgcgagcgttaatcggaattactgggcgtaaagggcgcgtaggcggttagttaagtgtgatgtgaaagccccgggcttaacctgggaagtgcatcgcaaactggttaactggagtatatgagagggtggcggaatttccggtgtagcggtgaaatgcgtagagatcggaaggaacgtcgatggcgaaggcagccacctggcataatactgacgctgatgcgcgaaagcgtggggagcgaacagg

SEQ ID NO: 1186 - DNA, 253 bp, Aquicella sp.
  OTU_390; Phylum: Proteobacteria; Class:  Gammaproteobacteria; Order:  Legionellales; Family:  Coxiellaceae
tacagagggtgcgagcgttaatcggagttactgggcgtaaagggcgcgtaggcggatatatgagtgttatgtgaaagccctgggcttaacctgggaagtgcatagcaaacgatatatctggagtacaagagagggtggcggaatttccggtgtagcggtgaaatgcgtagagatcggaaggaacgtcgatggcgaaggcagccacctggcttgatactgacgctgaggcgcgaaagcgtggggagcgaacagg

SEQ ID NO: 1187 - DNA, 253 bp, Aquicella sp.
  OTU_209; Phylum: Proteobacteria; Class:  Gammaproteobacteria; Order:  Legionellales; Family:  Coxiellaceae
tacagagggtgcgagcgttgatcggaattactgggcgtaaagggcgcgtaggcggttacatgagtgtgctgtgaaagccccgggcttaacctgggaagtgcagtgcaaacgatgtaactggagtagatgagagggtggtggaatttccggtgtagcggtgaaatgcgtagagatcggaaggaacgtcaatggcgaaggcagccacctggcatcatactgacgctgaggcgcgaaagcgtggggagcgaacagg

SEQ ID NO: 1188 - DNA, 253 bp, Unknown
  Description of Unknown: Polynucleotide
  OTU_197; Phylum: Proteobacteria; Class:  Gammaproteobacteria; Order:  Legionellales; Family:  Coxiellaceae
tacagagggtgcaagcgttaatcggatttactgggcgtaaagggcgcgtaggtggtagcgtaagtgagatgtgaaatccccgggcttaacctgggacgtgcatcttagactgcgtaacttgagtgtagtagagggtagtggaatttccggtgtagcggtgaaatgcgtagatatcggaaggaacaccagtggcgaaggcggctacctggactaacactgacactgaggcgcgagagcgtggggagcaaacagg

SEQ ID NO: 1189 - DNA, 253 bp, Haemophilus parainfluenzae
  OTU_3292; Phylum: Proteobacteria; Class:  Gammaproteobacteria; Order:  Pasteurellales; Family:  Pasteurellaceae
tacggagggtgcgagcgttaatcggaataactgggcgtaaagggcacgcaggcggtgacttaagtgaggtgtgaaagccccgggcttaacctgggaattgcactccatactgggtcgctagagtactttagggaggggtagaattccacgtgtagcggtgaaatgcgtggagatgtggaggaataccgaaggcgaaggcagccccttgggaatgtactgacgctcatgtgcgaaagcgtggggagcaaacagg

SEQ ID NO: 1190 - DNA, 253 bp, Haemophilus sp.
  OTU_363; Phylum: Proteobacteria; Class:  Gammaproteobacteria; Order:  Pasteurellales; Family:  Pasteurellaceae
tacggagggtgcgagcgttaatcggaataactgggcgtaaagggcacgcaggcggttatttaagtgaggtgtgaaagccccgggcttaacctgggaattgcatttcagactgggtaactagagtactttagggaggggtagaattccacgtgtagcggtgaaatgcgtagagatgtggaggaataccgaaggcgaaggcagccccttgggaatgtactgacgctcatgtgcgaaagcgtggggagcaaacagg

SEQ ID NO: 1191 - DNA, 253 bp, Acinetobacter rhizosphaerae
  OTU_155; Phylum: Proteobacteria; Class:  Gammaproteobacteria; Order:  Pseudomonadales; Family:  Moraxellaceae
tacagagggtgcaagcgttaatcggatttactgggcgtaaagcgcgcgtaggcggccaattaagtcaaatgtgaaatccccgagcttaacttgggaattgcattcgatactggttggctagagtgtgggagaggatggtagaattccaggtgtagcggtgaaatgcgtagagatctggaggaataccgatggcgaaggcagccatctggcctaacactgacgctgaggtgcgaaagcatggggagcaaacagg

SEQ ID NO: 1192 - DNA, 253 bp, Acinetobacter sp.
  OTU_216; Phylum: Proteobacteria; Class:  Gammaproteobacteria; Order:  Pseudomonadales; Family:  Moraxellaceae
tacagagggtgcgagcgttaatcggatttactgggcgtaaagcgtgcgtaggcggctttttaagtcggatgtgaaatccccgagcttaacttgggaattgcattcgatactgggaagctagagtatgggagaggatggtagaattccaggtgtagcggtgaaatgcgtagagatctggaggaataccgatggcgaaggcagccatctggcctaatactgacgctgaggtacgaaagcatggggagcaaacagg

SEQ ID NO: 1193 - DNA, 253 bp, Pseudomonas viridiflava
  OTU_2544; Phylum: Proteobacteria; Class:  Gammaproteobacteria; Order:  Pseudomonadales; Family:  Pseudomonadaceae
tacagagggtgcaagcgttagtcggaattactgggcgtaaagcgcgcgtaggtggttcgttaagttggatgtgaaagccccgggctcaacctgggaactgcatccaaaactggcgagctagagtagggcagagggtggtggaatttcctgtgtagcggtgaaatgcgtagatataggaaggaacaccagtggcgaaggcgaccacctgggctcatactgacactgaggtgcgaaagcgtggggagcaaacagg

SEQ ID NO: 1194 - DNA, 253 bp, Pseudomonas sp.
  OTU_11; Phylum: Proteobacteria; Class:  Gammaproteobacteria; Order:  Pseudomonadales; Family:  Pseudomonadaceae
tacagagggtgcaagcgttaatcggaattactgggcgtaaagcgcgcgtaggtggtttgttaagttggatgtgaaatccccgggctcaacctgggaactgcatccaaaactggcaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacagg

SEQ ID NO: 1195 - DNA, 253 bp, Pseudomonas sp.
  OTU_7; Phylum: Proteobacteria; Class:  Gammaproteobacteria; Order:  Pseudomonadales; Family:  Pseudomonadaceae
tacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacagg

SEQ ID NO: 1196 - DNA, 253 bp, Pseudomonas sp.
  OTU_3276; Phylum: Proteobacteria; Class:  Gammaproteobacteria; Order:  Pseudomonadales; Family:  Pseudomonadaceae
tacagagggtgcaagcgttaatcggaattactgggcgtaaagcgcgcgtaggtggcctggtaagttgaatgtgaaatccccgggctcaacctgggaactgcatccaaaactgcctggctagagtacggtagagggtggtggaatttcctgtgtagcggtgaaatgcgtagatataggaaggaacaccagtggcgaaggcgaccacctggactgatactgacactgaggtgcgaaagcgtggggagcaaacagg

SEQ ID NO: 1197 - DNA, 253 bp, Pseudomonas sp.
  OTU_3748; Phylum: Proteobacteria; Class:  Gammaproteobacteria; Order:  Pseudomonadales; Family:  Pseudomonadaceae
tacagagggtgcgagcgttaatcggaattactgggcgtaaagcgcgcgtaggtggtttgttaagttggatgtgaaatccccgggctcaacctgggaactgcattcaaaactgactgactagagtatggtagagggtggtggaatttcctgtgtaacggtgagatgcgtagatataggaaggaacaccagtggcgaaggcgaccacctggactgatactgacactgaggtgcgaaggcgtggagagcaaacagg

SEQ ID NO: 1198 - DNA, 253 bp, Pseudomonas sp.
  OTU_3228; Phylum: Proteobacteria; Class:  Gammaproteobacteria; Order:  Pseudomonadales; Family:  Pseudomonadaceae
tacagagggtgcaagcgttaatcggaattactgggcgtaaagcgcgcgtaggtagttcgttaagttggatgtgaaagccccgggctcaacctgggaactgcattcaaaactgacgagctagagtatggtagagggtggtggaatttcctgtgtagcggtgaaatgcgtagacataggaaggaacaccagtggcgaaggcgaccacctggactgatactgacgctgaggtgcgaaagcgtggggatcaaacagg

SEQ ID NO: 1199 - DNA, 253 bp, Pseudomonas sp.
  OTU_204; Phylum: Proteobacteria; Class:  Gammaproteobacteria; Order:  Pseudomonadales; Family:  Pseudomonadaceae
tacgaagggtgcaagcgttaatcggaattactgggcgtaaagcgcgcgtaggtggttcagcaagttggatgtgaaatccccgggctcaacctgggaactgcatccaaaactactgagctagagtacggtagagggtggtggaatttcctgtgtagcggtgaaatgcgtagatataggaaggaacaccagtggcgaaggcgaccacctggactgatactgacactgaggtgcgaaagcgtggggagcaaacagg

SEQ ID NO: 1200 - DNA, 253 bp, Pseudomonas sp.
  OTU_2653; Phylum: Proteobacteria; Class:  Gammaproteobacteria; Order:  Pseudomonadales; Family:  Pseudomonadaceae
tacggagggggctagcgttaatcggaattactgggcgtaaagcgcgcgtaggtggttcgttaagttggatgtgaaatccccgggctcaacctggggactgcattcaaaactgtcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacagg

SEQ ID NO: 1201 - DNA, 253 bp, Arenimonas sp.
  OTU_144; Phylum: Proteobacteria; Class:  Gammaproteobacteria; Order:  Xanthomonadales; Family:  Xanthomonadaceae
tacgaagggtgcaagcgttactcggaattactgggcgtaaagcgtgcgtaggtggttcgttaagtctgccgtgaaagccccgggctcaacctgggaatggcggtggatactggcggactagagtgcggtagagggtggtggaattcccggtgtagcagtgaaatgcgtagagatcgggaggaacatctgtggcgaaggcggccacctggaccagcactgacactgaggcacgaaagcgtggggagcaaacagg

SEQ ID NO: 1202 - DNA, 253 bp, Dokdonella sp.
  OTU_3850; Phylum: Proteobacteria; Class:  Gammaproteobacteria; Order:  Xanthomonadales; Family:  Xanthomonadaceae
tacgaagggtgcaagcgttactcggtatcactgggcataaagcgtgcgtaggcggttcgttgagtctgctgtgaaagccctgggctcaacctgggaactgcagtggatactggcgggctagagtgtgatagaggatggtggaattcccggagtagcggtgaaatgcgtagagatcgggaggaacaccagtggcgaaggcggccatctggatcaacactgacgctgaggcacgaaagcgtggggagcaaacagg

SEQ ID NO: 1203 - DNA, 253 bp, Luteimonas sp.
  OTU_177; Phylum: Proteobacteria; Class:  Gammaproteobacteria; Order:  Xanthomonadales; Family:  Xanthomonadaceae
tacgaagggtgcaagcgttactcggaattactgggcgtaaagcgtgcgtaggtggttcgttaagtctgatgtgaaagccctgggctcaacctgggaattgcattggatactggcgggctagagtgcggtagaggatggcggaattcccggtgtagcagtgaaatgcgtagagatcgggaggaacatctgtggcgaaggcggccatctggaccagcactgacactgaggcacgaaagcgtggggagcaaacagg

SEQ ID NO: 1204 - DNA, 253 bp, Lysobacter sp.
  OTU_194; Phylum: Proteobacteria; Class:  Gammaproteobacteria; Order:  Xanthomonadales; Family:  Xanthomonadaceae
tacgaagggtgcaagcgttactcggaattactgggcgtaaagcgtgcgtaggtggttcgttaagtctgatgtgaaagccctgggctcaacctgggaatggcattggatactggcgacctagagtgcggtagaggggtgtggaattcccggtgtagcagtgaaatgcgtagatatcgggaggaacatctgtggcgaaggcgacaccctggaccagcactgacactgaggcacgaaagcgtggggagcaaacagg

SEQ ID NO: 1205 - DNA, 253 bp, Rhodanobacter sp.
  OTU_527; Phylum: Proteobacteria; Class:  Gammaproteobacteria; Order:  Xanthomonadales; Family:  Xanthomonadaceae
tacgaagggtgcaagcgttaatcggaattactgggcgtaaagggtgcgtaggcggttatttaagtctgctgtgaaatccccgggctcaacctgggaatggcagtggatactggatagctagagtgtgtcagaggatggtggaattcccggtgtagcggtgaaatgcgtagagatcgggaggaacatcagtggcgaaggcggccatctgggacaacactgacgctgaagcacgaaagcgtggggagcaaacagg

SEQ ID NO: 1206 - DNA, 253 bp, Rhodanobacter sp.
  OTU_168; Phylum: Proteobacteria; Class:  Gammaproteobacteria; Order:  Xanthomonadales; Family:  Xanthomonadaceae
tacgaagggtgcaagcgttaatcggaattactgggcgtaaagggtgcgtaggcggttcgttaagtctgtcgtgaaatccccgggctcaacctgggaatggcgatggatactggcgagctagagtgtgtcagaggatggtggaattcccggtgtagcggtgaaatgcgtagagatcgggaggaacatcagtggcgaaggcggccatctgggacaacactgacgctgaagcacgaaagcgtggggagcaaacagg

SEQ ID NO: 1207 - DNA, 253 bp, Stenotrophomonas sp.
  OTU_83; Phylum: Proteobacteria; Class:  Gammaproteobacteria; Order:  Xanthomonadales; Family:  Xanthomonadaceae
tacgaagggtgcaagcgttactcggaattactgggcgtaaagcgtgcgtaggtggttatttaagtccgttgtgaaagccctgggctcaacctgggaactgcagtggatactggatgactagaatgtggtagagggtagcggaattcctggtgtagcagtgaaatgcgtagagatcaggaggaacatccatggcgaaggcagctacctggaccaacattgacactgaggcacgaaagcgtggggagcaaacagg

SEQ ID NO: 1208 - DNA, 253 bp, Stenotrophomonas sp.
  OTU_2829; Phylum: Proteobacteria; Class:  Gammaproteobacteria; Order:  Xanthomonadales; Family:  Xanthomonadaceae
tacgaagggtgcaagcgttactcggaattactgggcgtaaagcgtgcgtaggtggtcgtttaagtccgttgtgaaagccctgggctcaacctgggaactgcagtggatactgggcgactagagtgtggtagagggtagcggaattcctggtgtagcagtgaaatgcgtagagatcaggaggaacgtccatggcgaaggcatctacctggaccaacactgacactgaggcacgaaagcgtggggagcaaacggg

SEQ ID NO: 1209 - DNA, 253 bp, Xanthomonas axonopodis
  OTU_382; Phylum: Proteobacteria; Class:  Gammaproteobacteria; Order:  Xanthomonadales; Family:  Xanthomonadaceae
tacgaagggtgcaagcgttactcggaattactgggcgtaaagcgtgcgtaggtggtggtttaagtctgttgtgaaagccctgggctcaacctgggaattgcagtggatactggatcactagagtgtggtagagggtagcggaattcccggtgtagcagtgaaatgcgtagagatcgggaggaacatccgtggcgaaggcggctacctggaccaacactgacactgaggcacgaaagcgtggggagcaaacagg

SEQ ID NO: 1210 - DNA, 253 bp, Turneriella sp.
  OTU_334; Phylum: Spirochaetes; Class:  Leptospirae; Order:  Leptospirales; Family:  Leptospiraceae
tacgtatggggcaagcgttgttcggaattattgggcgtaaagggctcgcaggtggtttgttaagttggtggtttaatctctgggctcaacccagagtcagcctccaaaactggcgaacttgagtacgataggggatagcggaattctcggtgtagcggtggaatgcgtagatatcgagaggaacaccaatggcgaaggcagctatctggatcgtaactgacactcatgagcgaaagtgcggggagcaaacagg

SEQ ID NO: 1211 - DNA, 252 bp, Mycoplasma sp.
  OTU_89; Phylum: Tenericutes; Class:  Mollicutes; Order:  Mycoplasmatales; Family:  Mycoplasmataceae
aacataggtcacgagcattatccggatttattgggcgtaaaggaagcgtaggcggggaggttgatccattgttaaaagcatttgcttaacaaatgtgtgcattggagatcgcctccctagagttaatcagggggtactggaattcaatgtgtagcggtggaatgcgtagatatattgaggaacaccagaggctaaggcgagtgcctaggatataactgacgctgaggcttgaaagcgtggggagcaaatggg

SEQ ID NO: 1212 - DNA, 253 bp, Unknown
  Description of Unknown: Polynucleotide
  OTU_214; Phylum: Verrucomicrobia; Class:  Pedosphaerae; Order:  Pedosphaerales; Family:  auto67_4W
tacagaggtcccaagcgttgttcggattcactgggcgtaaagggtgcgtaggcggtcgggtaagtctgacgtgaaatcttcaagctcaacttggaaactgcgtcggatactattcggctcgaggaatggaggggagactggaatacttggtgtagcagtgaaatgcgtagatatcaagtggaacaccagtggcgaaggcgagtctctggacatttcctgacgctgaggcacgaaagccaggggagcaaacggg

SEQ ID NO: 1213 - DNA, 253 bp, Opitutus sp.
  OTU_385; Phylum: Verrucomicrobia; Class:  Opitutae; Order:  Opitutales; Family:  Opitutaceae
tacagagactgcaagcgttattcggattcactgggcgtaaagggtgcgcaggcggccatgtgtgtgaggcgtgaaagcccgatgctcaacatcggaattgcacctcaaactacatggctagagcattggagagggtagcggaattcacggtgtagcagtgaaatgcgtagatatcgtgaggaacaccagaggcgaaggcggctacctggacaattgctgacgctcaggcacgaaagcgtggggagcaaaaggg

SEQ ID NO: 1214 - DNA, 253 bp, Opitutus sp.
  OTU_252; Phylum: Verrucomicrobia; Class:  Opitutae; Order:  Opitutales; Family:  Opitutaceae
tacagagactgcaagcgttattcggattcactgggcgtaaagggtgcgcaggcggccgtgtgtgtcagatgtgaaatcccggggcttaactccggaactgcgtctgaaactacacggctagagcattggagagggtagtggaattcacggtgtagcagtgaaatgcgtagatatcgtgaggaacaccagaggcgaaggcgactacctggacaattgctgacgctcaggcacgaaagcgtggggagccaaaggg

SEQ ID NO: 1215 - DNA, 253 bp, Unknown
  Description of Unknown: Polynucleotide
  OTU_279; Phylum: Verrucomicrobia; Class:  Opitutae; Order:  Opitutales; Family:  Opitutaceae
tacagagactgcaagcgttattcggattcactgggcgtaaagggtgcgcaggcggttgggtgtgtcagatgtgaaatcccgaggctcaacctcggaactgcgtctgaaactactcgactagagtactggagagggtaacggaattcacggtgtagcagtgaaatgcgtagatatcgtgaggaacaccagaggcgaaggcggttacctggacagttactgacgctcaggcacgaaagcatggggagcaaaaggg

SEQ ID NO: 1216 - DNA, 253 bp, Luteolibacter sp.
  OTU_280; Phylum: Verrucomicrobia; Class:  Verrucomicrobiae; Order:  Verrucomicrobiales; Family:  Verrucomicrobiaceae
tacgaaggtcccaagcgttgttcggaatcactgggcgtaaagggagcgtaggcggcgtggtaagtcagatgtgaaatcccggggctcaaccccggaactgcatccgatactgccatgcttgagggttggagaggtagctggaattctcggtgtagcagtgaaatgcgtggatatcgagaggaacactcgtggcgaaggcgagctactggacaacatctgacgctgaggctcgaaggctaggggagcaaaaggg

SEQ ID NO: 1217 - DNA, 253 bp, Luteolibacter sp.
  OTU_172; Phylum: Verrucomicrobia; Class:  Verrucomicrobiae; Order:  Verrucomicrobiales; Family:  Verrucomicrobiaceae
tacgaaggtcccgagcgttgttcggaatcactgggcgtaaagggagcgtaggcggcgcggtaagtcagatgtgaaatcccggggctcaaccccggaactgcatccgatactgccgtgctagaggattggagaggtagctggaattcttggtgtagcagtgaaatgcgtggagatcaagaggaacactcgtggcgaaagcgagctactggacaatatctgacgctgaggctcgaaggccagggtagcgaaaggg

SEQ ID NO: 1218 - DNA, 20 bp, Unknown
  Description of Unknown: Oligonucleotide
atccgtggccgacgtcgtgc

SEQ ID NO: 1219 - DNA, 23 bp, Unknown
  Description of Unknown: Oligonucleotide
gcaacacgtttcggtgccggtgt

SEQ ID NO: 1220 - DNA, 20 bp, Unknown
  Description of Unknown: Oligonucleotide
ttgtcgactttcgtttcacc

SEQ ID NO: 1221 - DNA, 21 bp, Unknown
  Description of Unknown: Oligonucleotide
ctctcctaccatgcacataaa

SEQ ID NO: 1222 - DNA, 18 bp, Unknown
  Description of Unknown: Oligonucleotide
gctgcctcccgtaggagt

SEQ ID NO: 1223 - DNA, 18 bp, Unknown
  Description of Unknown: Oligonucleotide
gcagccacccgtaggtgt

SEQ ID NO: 1224 - DNA, 18 bp, Unknown
  Description of Unknown: Oligonucleotide
gctgccacccgtaggtgt

SEQ ID NO: 1225 - DNA, 20 bp, Unknown
  Description of Unknown: Oligonucleotide
tgcggctggatcacctcctt

SEQ ID NO: 1226 - DNA, 18 bp, Unknown
  Description of Unknown: Oligonucleotide
ggctgcttctaagccaac

SEQ ID NO: 1227 - DNA, 18 bp, Unknown
  Description of Unknown: Oligonucleotide
tgtaaaacgacggccagt

SEQ ID NO: 1228 - DNA, 19 bp, Unknown
  Description of Unknown: Oligonucleotide
ggaaacagctatgaccatg

SEQ ID NO: 1229 - DNA, 19 bp, Unknown
  Description of Unknown: Oligonucleotide
aaaaacgagccaaaagggc

SEQ ID NO: 1230 - DNA, 18 bp, Unknown
  Description of Unknown: Oligonucleotide
cgttatttcgcgctggtg

SEQ ID NO: 1231 - DNA, 253 bp, Enterobacter sp.; identical to SEQ ID NO: 1175
  OTU_118; Phylum: Proteobacteria; Class:  Gammaproteobacteria; Order:  Enterobacteriales; Family:  Enterobacteriaceae

SEQ ID NO: 1232 - DNA, 253 bp, Polaromonas sp.
  OTU_2272; Phylum: Proteobacteria; Class:  Betaproteobacteria; Order:  Burkholderiales; Family:  Comamonadaceae
tacgtagggtgcgagcgttaatcggaattactgggcgtaaagcgtgcgcaggcggttctataagacagatgtgaaatccccgggctcaacctgggaatggcatttgtgactgtagggctagagtacggtagagggggatggaattccgcgtgtagcagtgaaatgcgtagatatgcggaggaacaccgatggcgaaggcaatcccctggacctgtactgacgctcatgcacgaaagcgtggggagcaaacagg

SEQ ID NO: 1233 - DNA, 253 bp, Carboxydocella sp.; identical to SEQ ID NO: 1112
  OTU_615; Phylum: Firmicutes; Class:  Clostridia; Order:  Thermoanaerobacterales; Family:  Carboxydocellaceae

SEQ ID NO: 1234 - DNA, 253 bp, Staphylococcus sp.
  OTU_319; Phylum: Firmicutes; Class:  Bacilli; Order:  Bacillales; Family:  Staphylococcaceae
tacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacagg

SEQ ID NO: 1235 - DNA, 253 bp, Thermoanaerobacterium saccharolyticum; identical to SEQ ID NO: 1110
  OTU_436; Phylum: Firmicutes; Class:  Clostridia; Order:  Clostridiales; Family:  Clostridiaceae

SEQ ID NO: 1236 - DNA, 253 bp, Pantoea agglomerans; identical to SEQ ID NO: 1178
  OTU_1; Phylum: Proteobacteria; Class:  Gammaproteobacteria; Order:  Enterobacteriales; Family:  Enterobacteriaceae

SEQ ID NO: 1237 - DNA, 252 bp, Paenibacillus sp.; identical to SEQ ID NO: 1105
  OTU_16; Phylum: Firmicutes; Class:  Bacilli; Order:  Bacillales; Family:  Paenibacillaceae

SEQ ID NO: 1238 - DNA, 253 bp, Rhizobium sp.; identical to SEQ ID NO: 1123
  OTU_44; Phylum: Proteobacteria; Class:  Alphaproteobacteria; Order:  Rhizobiales; Family:  Rhizobiaceae

SEQ ID NO: 1239 - DNA, 253 bp, Prosthecobacter sp.
  OTU_65; Phylum: Verrucomicrobia; Class:  Verrucomicrobiae; Order:  Verrucomicrobiales; Family:  Verrucomicrobiaceae
tacagaggtctcaagcgttgttcggaatcactgggcgtaaagggtgcgtaggtggcgtggaaagtcagatgtgaaagcccggggctcaacctcggaattgcatccgatactaccatgctagagtactgaagaggtgactagaattctcggtgtagcagtgaaatgcgtagatatcgagaggaataccaacggcgaaggcaggtcactgggcagttactgacactgaggcacgaaggccaggggagcaaacggg

SEQ ID NO: 1240 - DNA, 253 bp, Geobacillus sp.; identical to SEQ ID NO: 1104
  OTU_272; Phylum: Firmicutes; Class:  Bacilli; Order:  Bacillales; Family:  Bacillaceae

SEQ ID NO: 1241 - DNA, 253 bp, Unknown
  Description of Unknown: Polynucleotide
  OTU_1534; Phylum: Proteobacteria; Class:  Betaproteobacteria; Order:  Burkholderiales; Family:  Oxalobacteraceae
tacgtagggtgcgagcgttaatcggaattactgggcgtaaagcgtgcgcaggcggttgggcaagaccgatgtgaaatccccgggcttaacctgggaatggcattggtgactgctcggctagagtgtgtcagaggggggtagaattccacgtgtagcagtgaaatgcgtagagatgtggaggaataccgatggcgaaggcagccccctgggataacactgacgctcaggcacgaaagcgtggggagcaaacagg

SEQ ID NO: 1242 - DNA, 253 bp, Unknown
  Description of Unknown: Polynucleotide
  OTU_2969; Phylum: Firmicutes; Class:  Bacilli; Order:  Bacillales; Family:  Bacillaceae
tacgtaggtggcaagcgttgtccggaattattgggcgtaaagcgcgcgcaggcggttccttaagtctgatgtgaaagcccacggctcaaccgtggagggtcattggaaactgggggacttgagtgcagaagaggagagcggaattccacgtgtagcggtgaaatgcgtagagatgtggaggaacaccagtggcaaaggcggcacactggtctgtaactgacgctgaggcgcgaaagcgtggggagcaaacagg

SEQ ID NO: 1243 - DNA, 253 bp, Phenylobacterium sp.
  OTU_85; Phylum: Proteobacteria; Class:  Alphaproteobacteria; Order:  Caulobacterales; Family:  Caulobacteraceae
tacgaagggggctagcgttgctcggaattactgggcgtaaagggcgcgtaggcggacagtttagtcagaggtgaaagcccagggctcaaccttggaattgcctttgatactggctgtcttgagtacgggagaggtgagtggaactccgagtgtagaggtgaaattcgtagatattcggaagaacaccagtggcgaaggcgactcactggcccgttactgacgctgaggcgcgaaagcgtggggagcaaacagg

SEQ ID NO: 1244 - DNA, 253 bp, Flavobacterium succinicans
  OTU_17; Phylum: Bacteroidetes; Class:  Flavobacteriia; Order:  Flavobacteriales; Family:  Flavobacteriaceae
tacggaggatccaagcgttatccggaatcattgggtttaaagggtccgtaggcggtcttgtaagtcagtggtgaaagcccatcgctcaacggtggaacggccattgatactgctggacttgaattactgggaagcaactagaatatgtagtgtagcggtgaaatgcttagagattacatggaataccaattgcgaaggcaggttgctaccagtggattgacgctgatggacgaaagcgtgggtagcgaacagg

SEQ ID NO: 1245 - DNA, 253 bp, Unknown
  Description of Unknown: Polynucleotide
  OTU_70; Phylum: Bacteroidetes; Class:  Cytophagia; Order:  Cytophagales; Family:  Cytophagaceae
tacgtaggtggcaagcgttgtccggatttattgggtttaaagggtgcgtaggcggcctattaagtcagttctgaaatatcccggcttaaccgggagggtgggattgatactgatgggcttgagtggaatcgaggtaggcggaattgacggtgtagcggtgaaatgcttagatatcgtcaagaacaccgatagtgtagacagcttactagacttcaactgacgctgaggcacgaaagtgtggggatcaaacagg

SEQ ID NO: 1246 - DNA, 253 bp, Unknown
  Description of Unknown: Polynucleotide
  OTU_178; Phylum: Bacteroidetes; Class:  Saprospirae; Order:  Saprospirales; Family:  Chitinophagaceae
tacggagggtgcaagcgttatccggattcactgggtttaaagggtgcgtaggcggacaggtaagtcagtggtgaaatctccgagcttaactcggaaactgccgttgatactatttgtcttgaatattgtggaggtaagcggaatatgtcatgtagcggtgaaatgcttagatatgacatagaacaccaattgcgaaggcagcttgctacacaatcattgacgctgaggcacgaaagcgtggggatcaaacagg

SEQ ID NO: 1247 - DNA, 253 bp, Escherichia coli
  OTU_1884; Phylum: Proteobacteria; Class:  Gammaproteobacteria; Order:  Enterobacteriales; Family:  Enterobacteriaceae
tacggagggtgcaagcgttaatcggaattactgggcgtaaagcgcacgcaggcggtttgttaagtcagatgtgaaatccccgggcccaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacagg

SEQ ID NO: 1248 - DNA, 253 bp, Shinella sp.
  OTU_2846; Phylum: Proteobacteria; Class:  Alphaproteobacteria; Order:  Rhizobiales; Family:  Rhizobiaceae
tacgaagggggctagcgttgttcggaattactgggcgtaaagcgcacgtaggcggatatttaagtcaggggtgaaatcccggggctcaaccccggaactgcctttgatactgggtatctggagtatggaagaggtaagtggagttccgagcgtagaggtgaaatccgtagatattcggaggaacaccagtggcgaaggcggcttactggtccattactgacgctgaggtgcgaaagcgtggggagcaaacagg

SEQ ID NO: 1249 - DNA, 253 bp, Pedobacter sp.
  OTU_43; Phylum: Bacteroidetes; Class:  Sphingobacteriia; Order:  Sphingobacteriales; Family:  Sphingobacteriaceae
tacggaggatccaagcgttatccggatttattgggtttaaagggtgcgtaggcggcctgttaagtcaggggtgaaagacggtagctcaactatcgcagtgcccttgatactgatgggcttgaatacactagaggtaggcggaatgtgacaagtagcggtgaaatgcatagatatgtcacagaacaccgattgcgaaggcagcttactatggtgtcattgacgctgaggcacgaaagcgtggggatcaaacagg

SEQ ID NO: 1250 - DNA, 253 bp, Luteolibacter sp.
  OTU_37; Phylum: Verrucomicrobia; Class:  Verrucomicrobiae; Order:  Verrucomicrobiales; Family:  Verrucomicrobiaceae
tacgaaggtcccaagcgttgttcggaatcactgggcgtaaagggagcgtaggcggcgtggtaagtcagatgtgaaatcccggggctcaaccccggaactgcatccgatactgccatgcttgagggttggagaggtagctggaattctcggtgtagcagtgaaatgcgtggatatcgagaggaacactcgtggcgaaggcgagctactggacaacatctgacgctgaggctcgaaggccaggggagcaaaaggg

SEQ ID NO: 1251 - DNA, 253 bp, Sediminibacterium sp.
  OTU_72; Phylum: Bacteroidetes; Class:  Saprospirae; Order:  Saprospirales; Family:  Chitinophagaceae
tacggagggtgcaagcgttatccggattcactgggtttaaagggtgcgtaggcgggcaggtaagtcagtggtgaaatcctagagcttaactctagaactgccattgatactatctgtcttgaatattgtggaggtaagcggaatatgtcatgtagcggtgaaatgcttagatatgacatagaacacctattgcgaaggcagcttactacgcatatattgacgctgaggcacgaaagcgtggggatcaaacagg

SEQ ID NO: 1252 - DNA, 253 bp, Unknown
  Description of Unknown: Polynucleotide
  OTU_1363; Phylum: Firmicutes; Class:  Bacilli; Order:  Bacillales; Family:  Staphylococcaceae
tacgtaggtggcaagcgttatccggaattattgggcgtaaagcgcgcgtaggcggtctcttaagtctgatgtgaaagcccccggctcaaccggggagggtcattggaaactgggagacttgagtgcagaagaggagagtggaattccatgtgtagcggtgaaatgcgcagagatatggaggaacaccagtggcgaaggcggctctctggtctgtaactgacgctgaggtgcgaaagcgtggggatcaaacagg

SEQ ID NO: 1253 - DNA, 253 bp, Alicyclobacillus sp.
  OTU_777; Phylum: Firmicutes; Class:  Bacilli; Order:  Bacillales; Family:  Alicyclobacillaceae
tacgtagggggcaagcgttgtccggattcactgggcgtaaagcgcgcgcaggcggtgatgtaagtctgaggtgaaaacccgaagctcaacttcgggactgccttggatactgcgtcacttgaggataggagaggcaaggggaattccacgtgtagcggtgaaatgcgtagagatgtggaggaacacctgtggcgaaggcgccttgctggcctatttctgacgctgaggcgcgaaagcgtggggagcaaacagg

SEQ ID NO: 1254 - DNA, 253 bp, Unknown
  Description of Unknown: Polynucleotide
  OTU_81; Phylum: Verrucomicrobia; Class:  Spartobacteria; Order:  Chthoniobacterales; Family:  Chthoniobacteraceae
tacagaggtctcaaccgttgttcggattcattgggcgtaaagggtgcgtaggcggtcgcgcaagtcggatgtgaaatctcagggctcaaccctgaaactgcattcgatactgcgtggctagagtactggagaggagactggaatttacggtgtagcagtgaaatgcgtagatatcgtaaggaagaccagtggcgaaggcgagtctctggacagtaactgacgctgaggcacgaaggccaggggagcaaacggg

SEQ ID NO: 1255 - DNA, 253 bp, Janthinobacterium sp.
  OTU_49; Phylum: Proteobacteria; Class:  Betaproteobacteria; Order:  Burkholderiales; Family:  Oxalobacteraceae
tacgtagggtgcaagcgttaatcggaattactgggcgtaaagcgtgcgcaggcggttttgtaagtctgttgtgaaatccccgggcttaacctgggaatggcaatggagactgcaaggctagagtttggcagaggggggtagaattccacgtgtagcagtgaaatgcgtagagatgtggaggaacaccgatggcgaaggcagccccctgggtcaaaactgacgctcatgcacgaaagcgtggggagcaaacagg

SEQ ID NO: 1256 - DNA, 253 bp, Sediminibacterium sp.; identical to SEQ ID NO: 1060
  OTU_290; Phylum: Bacteroidetes; Class:  Saprospirae; Order:  Saprospirales; Family:  Chitinophagaceae

SEQ ID NO: 1257 - DNA, 250 bp, Dyadobacter sp.
  OTU_3268; Phylum: Bacteroidetes; Class:  Cytophagia; Order:  Cytophagales; Family:  Cytophagaceae
tacggagggtgcgagcgttgtccggatttattgggtttaaagggtgcgtaggtggctttataagtcagtggtgaaatacggttgctcaaccgaggtgccattgatactgcaaagcttgaaataattggaggctgccggaatggatggtgtagcggtgaaatgcatagatatcatccagaacaccgattgcgaaggcaggtggctacgattggtttgacactgaggcacgaaagcatggggagcaaacagg

SEQ ID NO: 1258 - DNA, 253 bp, Unknown
  Description of Unknown: Polynucleotide
  OTU_96; Phylum: Proteobacteria; Class:  Betaproteobacteria; Order:
tacgtagggtgcaggcgttaatcggaattactgggcgtaaagcgtgcgcaggcggtttgctaagacaggtgtgaaatccccgagcttaacttgggaattgcgcttgtaactggcaggctagagtgtagcagaggggggtggaattccacgtgtagcagtgaaatgcgtagatatgtggaggaacaccgatggcgaaggcagccccctgggttaacactgacgctcatgcacgaaagcgtggggagcaaacagg

SEQ ID NO: 1259 - DNA, 253 bp, Unknown
  Description of Unknown: Polynucleotide
  OTU_119; Phylum: Bacteroidetes; Class:  Sphingobacteriia; Order:  Sphingobacteriales; Family:  Sphingobacteriaceae
tacggaggatccaagcgttatccggatttattgggtttaaagggtgcgtaggcggcctattaagtcaggggtgaaagacggtggctcaaccatcgcagtgcccttgatactgatgggcttgattacacttgaggtaggcggaatgtgacaagtagcggtgaaatgcatagatatgtcacagaacaccaattgcgaaggcagcttactaaggtgtcaatgacgctgaggcacgaaagcgtggggatcaaacagg

SEQ ID NO: 1260 - DNA, 253 bp, Flavobacterium succinicans
  OTU_721; Phylum: Bacteroidetes; Class:  Flavobacteriia; Order:  Flavobacteriales; Family:  Flavobacteriaceae
tacggaggatccaagcgttatccggaatcattgggtttaaagggttcgtaggcggtcttgtaagtcagtggtgaaagcccatcgctcaacggtggaacggccattgatactgcaggacttgaattattgggaagtaactagaatatgtagtgtagcggtgaaatgcttagagattacatggaataccaattgcgaaggcaggttactaccaatttattgacgctgatggacgaaagcgtgggtagcgaacagg

SEQ ID NO: 1261 - DNA, 253 bp, Unknown
  Description of Unknown: Polynucleotide
  OTU_873; Phylum: Proteobacteria; Class:  Betaproteobacteria; Order:  Burkholderiales; Family:  Alcaligenaceae
tacgtagggtgcaagcgttaatcggaattactgggcgtaaagcgtgcgcaggcggtttggaaagaaagatgtgaaatcccagagcttaactttggaactgcatttttaactgccaagctagagtatgtcagaggggggtagaattccacgtgtagcagtgaaatgcgtagagatgtggaggaataccgatggcgaaggcagccccctgggataatactgacgctcatgcacgaaagcgtggggagcaaacagg

SEQ ID NO: 1262 - DNA, 253 bp, Rubrobacter sp.
  OTU_483; Phylum: Actinobacteria; Class:  Rubrobacteria; Order:  Rubrobacterales; Family:  Rubrobacteraceae
tacgtagggggcgagcgttgtccggaatcattgggcgtaaagagcgtgtaggcggcccggtaagtccgctgtgaaaacccggggctcaaccccgggcgtgcagtggaaactgccgggctagagggcggcagaggcgagtggaattcccggtgtagcggtgaaatgcgcagatatcgggaggaacaccagtagcgaaggcggctcgctgggccgttcctgacgctgagacgcgaaagctaggggagcgaacagg

SEQ ID NO: 1263 - DNA, 253 bp, Dyadobacter sp.; identical to SEQ ID NO: 1067
  OTU_7; Phylum: Bacteroidetes; Class:  Cytophagia; Order:  Cytophagales; Family:  Cytophagaceae

SEQ ID NO: 1264 - DNA, 253 bp, Unknown
  Description of Unknown: Polynucleotide
  OTU_69; Phylum: Proteobacteria; Class:  Betaproteobacteria; Order:  IS-44
tacgtagggtgcgagcgttaatcggaattactgggcgtaaagcgtgcgcaggcggttcgccaagtcaggtgtgaaatccccgggcttaacctgggaattgcgcttgaaactagcgggcttgagtgtggcagaggggggtggaattccacgtgtagcagtgaaatgcgtagagatgtggaggaacaccgatggcgaaggcagccccctgggtcaacactgacgctcatgcacgaaagcgtggggagcaaacagg

SEQ ID NO: 1265 - DNA, 253 bp, Chryseobacterium sp.
  OTU_24; Phylum: Bacteroidetes; Class:  Flavobacteriia; Order:  Flavobacteriales; Family:  Weeksellaceae
tacggagggtgcaagcgttatccggatttattgggtttaaagggtccgtaggcggacctgtaagtcagtggtgaaatctcatagcttaactatgaaactgccattgatactgcaggtcttgagtaaatttgaagtggctggaataagtagtgtagcggtgaaatgcatagatattacttagaacaccaattgcgaaggcaggtcactaagatttaactgacgctgagggacgaaagcgtggggagcgaacagg

SEQ ID NO: 1266 - DNA, 253 bp, Unknown
  Description of Unknown: Polynucleotide
  OTU_56; Phylum: Proteobacteria; Class:  Deltaproteobacteria; Order:  Myxococcales
tacagagggtgcaagcgttgttcggaattattgggcgtaaagcgcgtgtaggcggcttggcaagtcagatgtgaaagccctcggcttaaccgaggaagtgcgtctgaaactgctgagcttgagtctcggagaggatggcggaattccgcaagtagaggtgaaattcgtagatatgcggaggaacaccggtggcgaaggcggccatctggacgagtactgacgctgagacgcgaaagcgtggggagcaaacagg

SEQ ID NO: 1267 - DNA, 253 bp, Unknown
  Description of Unknown: Polynucleotide
  OTU_91; Phylum: Proteobacteria; Class:  Deltaproteobacteria; Order:  Myxococcales
gacagagggtgcaaacgttgttcggaattactgggcgtaaagcgcgtgtaggcggcaatacaagtcggatgtgaaatcccgcggcttaaccgtggaagtgcacccgaaactgtatcgctagagtcccggagaggatggtggaatacttggtgtagaggtgaaattcgtagatatcaagtggaacaccggtggcgaaggcggccatctggacggtgactgacgctgagacgcgaaagcgtgggtagcaaacagg

SEQ ID NO: 1268 - DNA, 253 bp, Devosia sp.
  OTU_2819; Phylum: Proteobacteria; Class:  Alphaproteobacteria; Order:  Rhizobiales; Family:  Hyphomicrobiaceae
tacgaagggggctagcgttgttcggatttactgggcgtaaagcgcacgtaggcggattgttaagtcaggggtgaaatcctggagctcaactccagaactgcctttgatactggcagtctagagaccggaagaggtgagtggaacccctagtgtagaggtggaattcgtagatattaggaaggacaccagtggcgaaggcggctcactggtccggtactgacgctgaggtgcgaaagcgtggggagcaaacagg

SEQ ID NO: 1269 - DNA, 253 bp, Unknown
  Description of Unknown: Polynucleotide
  OTU_78; Phylum: Bacteroidetes; Class:  Saprospirae; Order:  Saprospirales; Family:  Chitinophagaceae
tacggagggtgcaagcgttatccggattcactgggtttaaagggtgcgtaggtgggtatgtaagtcagtggtgaaatccccgagcttaacttgggaactgccgttgatactatatatcttgaatgtcgtagaggtaagcggaatatgtcatgtagcggtgaaatgcttagagatgacatagaacaccaattgcgaaggcagcttgctatgcgattattgacactgaggcacgaaagcgtgggtagcaaacagg

SEQ ID NO: 1270 - DNA, 253 bp, Luteolibacter sp.
  OTU_399; Phylum: Verrucomicrobia; Class:  Verrucomicrobiae; Order:  Verrucomicrobiales; Family:  Verrucomicrobiaceae
tacgaaggtcccgagcgttgttcggaatcactgggcgtaaagggagcgtaggcggcatggtaagtcagatgtgaaatcccggggctcaaccccggaactgcatccgatactgccttgcttgagggttggagaggtgactggaattctcggtgtagcagtgaaatgcgtggatatcgagaggaacactcgtggcgaaggcgagtcactggacaacatctgacgctgaggctcgaaggctaggggagcaaaaggg

SEQ ID NO: 1271 - DNA, 253 bp, Rhodoferax sp.
  OTU_32; Phylum: Proteobacteria; Class:  Betaproteobacteria; Order:  Burkholderiales; Family:  Comamonadaceae
tacgtagggtgcgagcgttaatcggaattactgggcgtaaagcgtgcgcaggcggttatgtaagacagatgtgaaatccccgggctcaacctgggacctgcatttgtgactgcatagctagagtacggtagagggggatggaattccgcgtgtagcagtgaaatgcgtagatatgcggaggaacaccgatggcgaaggcaatcccctggacctgtactgacgctcatgcacgaaagcgtggggagcaaacagg

SEQ ID NO: 1272 - DNA, 253 bp, Cellvibrio sp.
  OTU_45; Phylum: Proteobacteria; Class:  Gammaproteobacteria; Order:  Alteromonadales; Family:  Alteromonadaceae
tacggagggtgcaagcgttaatcggaattactgggcgtaaagcgcacgtaggtggtttgctaagtcagctgtgaaatccccgggctcaacctgggcactgcagttgaaactggcaagctagagtagggtagaggggtgtggaattccaggtgtagcggtgaaatgcgtagatatctggaggaacatcagtggcgaaggcgacaccctggactcatactgacactgaggtgcgaaagcgtggggagcaaacagg

SEQ ID NO: 1273 - DNA, 253 bp, Rhodanobacter sp.; identical to SEQ ID NO: 1206
  OTU_76; Phylum: Proteobacteria; Class:  Gammaproteobacteria; Order:  Xanthomonadales; Family:  Xanthomonadaceae

SEQ ID NO: 1274 - DNA, 253 bp, Unknown
  Description of Unknown: Polynucleotide
  OTU_3658; Phylum: Proteobacteria; Class:  Alphaproteobacteria; Order:  Rhizobiales
tacgaagggggctagcgttgttcggaattactgggcgtaaagcgcacgtaggcggacatttaagtcaggggtgaaatcccggagctcaactccggaactgcctttgatactgggtgtctcgagtatggaagaggtgagtggaattccgagtgtagaggtgaaattcgtagatattcggaggaacaccagtggcgaaagcaactcactgatccattactgacgctgaggtacgaaagcgtggggagcaaacagg

SEQ ID NO: 1275 - DNA, 253 bp, Deinococcus geothermalis
  OTU_1300; Phylum: Thermi; Class:  Deinococci; Order:  Deinococcales; Family:  Deinococcaceae
tacggagggtgcaagcgttacccggaatcactgggcgtaaagggcgtgtaggcggaaggttaagtccgactttaaagaccggggctcaaccccgggcctgggttggagactggctttctggacctctggagaggcaactggaattcctggtgtagcggtggaatgcgtagataccaggaggaacaccgatggcgaaggcaggttgctggacagaaggtgacgctgaggcgcgaaagtgtggggagcgaaccgg

SEQ ID NO: 1276 - DNA, 253 bp, Janthinobacterium sp.
  OTU_3; Phylum: Proteobacteria; Class:  Betaproteobacteria; Order:  Burkholderiales; Family:  Oxalobacteraceae
tacgtagggtgcaagcgttaatcggaattactgggcgtaaagcgtgcgcaggcggttttgtaagtctgtcgtgaaagccccgggcttaacctgggaattgcgatggagactgcaaggcttgaatctggcagaggggggtagaattccacgtgtagcagtgaaatgcgtagagatgtggaggaacaccgatggcgaaggcagccccctgggtcaagattgacgctcatgcacgaaagcgtggggagcaaacagg

SEQ ID NO: 1277 - DNA, 253 bp, Bacillus racemilacticus
  OTU_502; Phylum: Firmicutes; Class:  Bacilli; Order:  Bacillales; Family:  Sporolactobacillaceae
tacgtaggtggcaagcgttgtccggaattattgggcgtaaagcgcgcgcaggcggtttcttaagtctgatgtgaaagcccccagctcaactggggagggtcattggaaactgggaaacttgagtacagaagaggagagtagaattccacgtgtagcggtgaaatgcgtagagatgtggaggaataccagtggcgaaggcggctctctggtctgtaactgacgctgaggcgcgaaagcgtggggagcaaacagg

SEQ ID NO: 1278 - DNA, 253 bp, Agrobacterium sp.
  OTU_5; Phylum: Proteobacteria; Class:  Alphaproteobacteria; Order:  Rhizobiales; Family:  Rhizobiaceae
tacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattccgagtgtagaggtgaaattcgtagatattcggaggaacaccagtggcgaaggcggcttactggtccattactgacgctgaggtgcgaaagcgtggggagcaaacagg

SEQ ID NO: 1279 - DNA, 253 bp, Cellvibrio sp.
  OTU_1751; Phylum: Proteobacteria; Class:  Gammaproteobacteria; Order:  Alteromonadales; Family:  Alteromonadaceae
tacggagggtgcaagcgttaatcggaattactgggcgtaaagcgcacgtaggtggttcgctaagtcagctgtgaaatccccgggctcaacctgggacttgcagttgaaactggtgagctagagtagggtagaggggtgtggaattccaggtgtagcggtgaaatgcgtagatatctaaaggaacatcagtggcgaaaacaacaccctggactcatactgacactgaggtgcgaaagcgtggggagcaaacagg

SEQ ID NO: 1280 - DNA, 253 bp, Cytophaga sp.
  OTU_41; Phylum: Bacteroidetes; Class:  Cytophagia; Order:  Cytophagales; Family:  Cytophagaceae
tacgtaggtggcaagcgttgtccggatttattgggtttaaagggtgcgtaggcggcattataagtcagtggtgaaagccgatcgcttaacgatcgaactgccattgatactgtagtgcttgagtatagttgaggtaggcggaattgacagtgtagcggtgaaatgcatagatattgtcaagaacaccaattgcgaaggcagcttactaaagtataactgacgctgaggcacgaaagtgcggggatcaaacagg

SEQ ID NO: 1281 - DNA, 253 bp, Unknown
  Description of Unknown: Polynucleotide
  OTU_127; Phylum: Proteobacteria; Class:  Alphaproteobacteria; Order:  BD7-3
tacggagggagcgagcgttgttcggaattactgggcgtaaagggtgcgcaggcggctatgtaagtcggaagtgaaatcccagggcttaaccctggaattgctttcgaaactatatagctcgagtctcggagaggttagcggaattcctagtgtagaggtgaaattcgtagatattaggaggaacaccagtggcgtaagcggctaactagacgagtactgacgctcaagcacgaaagcgtggggatcaaacagg

SEQ ID NO: 1282 - DNA, 253 bp, Ammoniphilus sp.
  OTU_108; Phylum: Firmicutes; Class:  Bacilli; Order:  Bacillales; Family:  Paenibacillaceae
tacgtagggggcaagcgttgtccggaattattgggcgtaaagcgcgcgcaggcggcctattaagtctgatgtgaaagcccacggctcaaccgtggagggccattggaaactggtaggcttgagtgcaggagaggagagcggaattcctggtgtagcggtgaaatgcgtagatatcaggaggaacacccgtggcgaaggcggctctctggcctgtaactgacgctgaggcgcgaaagcgtggggagcaaacagg

SEQ ID NO: 1283 - DNA, 253 bp, Unknown
  Description of Unknown: Polynucleotide
  OTU_68; Phylum: Proteobacteria; Class:  Betaproteobacteria; Order:  Burkholderiales; Family:  Comamonadaceae
tacgtagggtgcaagcgttaatcggaattactgggcgtaaagcgtgcgcaggcggtgatgtaagacaggtgtgaaatccccgggcttaacctgggaactgcatttgtgactgcatcgctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacagg

SEQ ID NO: 1284 - DNA, 253 bp, Devosia sp.
  OTU_57; Phylum: Proteobacteria; Class:  Alphaproteobacteria; Order:  Rhizobiales; Family:  Hyphomicrobiaceae
tacgaagggggctagcgttgttcggatttactgggcgtaaagcgcacgtaggcggtttgttaagtcaggggtgaaatcccggagctcaactccggaactgcctttgatactggcaagctagagtccggaagaggtgagtggaactcctagtgtagaggtggaattcgtagatattaggaagaacaccagtggcgaaggcggctcactggtccggtactgacgctgaggtgcgaaagcgtggggagcaaacagg

SEQ ID NO: 1285 - DNA, 253 bp, Janthinobacterium sp.
  OTU_2460; Phylum: Proteobacteria; Class:  Betaproteobacteria; Order:  Burkholderiales; Family:  Oxalobacteraceae
tacgtagggtgcaagcgttaatcggaattactgggcgtaaagcgtgcgcaggcggttttgtaagactgtcgtgaaatccccgggctcaacctgggaatggcgatggtgactgcaaggctagagtttggcagaggggggtagaattccacgtgtagcagtgaaatgcgtagatatgtggaggaacaccgatggcgaaggcagccccctgggtcaagattgacgctcatgcacgaaagcgtggggagcaaacagg

SEQ ID NO: 1286 - DNA, 253 bp, Pedobacter sp.
  OTU_2017; Phylum: Bacteroidetes; Class:  Sphingobacteriia; Order:  Sphingobacteriales; Family:  Sphingobacteriaceae
tacggaggatccaagcgttatccggatttattgggtttaaagggcgcgtaggcggcctgttaagtcaggggtgaaagacggtagctcaactatcgcagtgcccttgatactgacgggcttgaattgactagaggtaggcggaatgagacaagtagcggtgaaatgcatagatatgtctcagaacaccgattgcgaaggcagcttactatggtcacattgacgctgaggcacgaaagcgtggggatcaaacagg

SEQ ID NO: 1287 - DNA, 253 bp, Flavisolibacter sp.
  OTU_75; Phylum: Bacteroidetes; Class:  Saprospirae; Order:  Saprospirales; Family:  Chitinophagaceae
tacggagggtgcaagcgttatccggattcactgggtttaaagggtgcgtaggagggcaggtaagtcagtggtgaaatctccgagcttaactcggaaactgccgttgatactatctgtcttgaatattgtggaggtgagcggaatatgtcatgtagcggtgaaatgcttagatatgacatagaacaccaattgcgaaggcagctcgctacacatatattgactctgaggcacgaaagcgtggggatcaaacagg

SEQ ID NO: 1288 - DNA, 253 bp, Asticcacaulis sp.
  OTU_42; Phylum: Proteobacteria; Class:  Alphaproteobacteria; Order:  Caulobacterales; Family:  Caulobacteraceae
tacgaagggggctagcgttgctcggaattactgggcgtaaagggagcgtaggcgggttatcaagttgggggtgaaagcccggggctcaacctcggaattgccttcaaaactggtagcctagagtatgatagaggtatgtggaactccgagtgtagaggtgaaattcgtagatattcggaagaacaccagtggcgaaggcgacatactgggtcatgactgacgctgaggctcgaaagcgtggggagcaaacagg

SEQ ID NO: 1289 - DNA, 253 bp, Unknown
  Description of Unknown: Polynucleotide
  OTU_29; Phylum: Proteobacteria; Class:  Gammaproteobacteria; Order:  Xanthomonadales; Family:  Xanthomonadaceae
tacgaagggtgcaagcgttactcggaattactgggcgtaaagcgtgcgtaggtggtgatttaagtcagatgtgaaagccctgggctcaacctgggaactgcatttgatactgggtcactagagtgcggtagaggatagcggaattcctggtgtagcagtgaaatgcgtagagatcaggaggaacatccgtggcgaaggcggctatctgggccagcactgacactgaggcacgaaagcgtggggagcaaacagg

SEQ ID NO: 1290 - DNA, 253 bp, Flavisolibacter sp.
  OTU_79; Phylum: Bacteroidetes; Class:  Saprospirae; Order:  Saprospirales; Family:  Chitinophagaceae
tacggagggtgcaagcgttatccggattcactgggtttaaagggtgcgtaggagggcaggtaagtcagtggtgaaatctccaagcttaacttggaaactgccgttgatactatctgtcttgaataccgtggagatgagcggaatatgtcatgtagcggtgaaatgcttagatatgacatagaacaccaattgcgaaggcagctcgttacacgaatattgactctgaggcacgaaagcgtggggatcaaacagg

SEQ ID NO: 1291 - DNA, 253 bp, Pseudomonas sp.; identical to SEQ ID NO: 1194
  OTU_9; Phylum: Proteobacteria; Class:  Gammaproteobacteria; Order:  Pseudomonadales; Family:  Pseudomonadaceae

SEQ ID NO: 1292 - DNA, 253 bp, Unknown
  Description of Unknown: Polynucleotide
  OTU_63; Phylum: Planctomycetes; Class:  Planctomycetia; Order:  Pirellulales; Family:  Pirellulaceae
gacgagctctccaaacgttattcggtatcactgggcttaaagagttcgtaggcggcttgacaggtgaggtgtgaaagcccacggcctaaccgtggaattgcgcttcaaaccgtcgggctagagggatgcaggggtatgcggaacagatggtggagcggtgaaatgcgttgatatcatctggaacaccggtggcgaaagcggcatactgggcattttctgacgctgaggaacgaaagctagggtagcgaacggg

SEQ ID NO: 1293 - DNA, 253 bp, Unknown
  Description of Unknown: Polynucleotide
  OTU_87; Phylum: Bacteroidetes; Class:  Saprospirae; Order:  Saprospirales; Family:  Chitinophagaceae
tacggagggtgcaagcgttatccggatttactgggtttaaagggtgcgtaggtgggtctgtaagtcagtggtgaaatctccgagcttaactcggaaactgccattgatactataggtcttgaattatctggaggtaagcggaatatgtcatgtagcggtgaaatgcttagatatgacatagaacaccaattgcgaaggcagcttactacggattgattgacactgaggcacgaaagcgtggggatcaaacagg

SEQ ID NO: 1294 - DNA, 253 bp, Unknown
  Description of Unknown: Polynucleotide
  OTU_2547; Phylum: Proteobacteria; Class:  Gammaproteobacteria; Order:  Pseudomonadales; Family:  Pseudomonadaceae
tacgaagggtgcaagcgttactcggaattactgggcgtaaagcgcgcgtaggtggttcgttaagttggatgtgaaatccccgggctcaacctgggaactgcactcaaaactgtcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacagg

SEQ ID NO: 1295 - DNA, 253 bp, Unknown
  Description of Unknown: Polynucleotide
  OTU_2433; Phylum: Proteobacteria; Class:  Alphaproteobacteria; Order:  Rhizobiales; Family:  Rhizobiaceae
tacgaagggggctagcgttgttcggaattactgggcgtaaagcgcacgtaggcgggtatttaagtcgggggtgaaatcccggagctcaactccggaactgcctttgatactgggtacctagagtatggaagaggtaagtggaattccgagtgtagaggtgaaattcgtggatattcggaggaacaccagtggcgaaggcggctcactggtccattactgacgctgaggtgcgaaagcgtggggagcaaacagg

SEQ ID NO: 1296 - DNA, 252 bp, Paenibacillus sp.
  OTU_18; Phylum: Firmicutes; Class:  Bacilli; Order:  Bacillales; Family:  Paenibacillaceae
tacgtagggggcaagcgttgtccggaattattgggcgtaaagcgcgcgcaggcggctttgtaagtcttgtgtttaagttcggggcttaaccccgtgtcgcatgggaaactgcaaggcttgagtgcagaagaggaaagtggaattccacgtgtagcggtgaaatgcgtagagatgtggaggaacaccagtggcgaaggcgactttctgggctgtaactgacgctgaggcgcgaaagcgtggggagcaaacagg

SEQ ID NO: 1297 - DNA, 253 bp, Chitinophaga sp.
  OTU_23; Phylum: Bacteroidetes; Class:  Saprospirae; Order:  Saprospirales; Family:  Chitinophagaceae
tacggagggtgcaagcgttatccggattcactgggtttaaagggtgcgtaggcggacatgtaagtctgtggtgaaatctccgagcttaactcggaaactgccgtggatactatatgtcttgaatgttgtggaggttagcggaatatgtcatgtagcggtgaaatgcttagatatgacatagaacaccgattgcgaaggcagctggctacacaactattgacgctgaggcacgaaagcgtggggatcaaacagg

SEQ ID NO: 1298 - DNA, 253 bp, Aeromicrobium sp.; identical to SEQ ID NO: 1042
  OTU_173; Phylum: Actinobacteria; Class:  Actinobacteria; Order:  Actinomycetales; Family:  Nocardioidaceae

SEQ ID NO: 1299 - DNA, 253 bp, Novosphingobium sp.
  OTU_3034; Phylum: Proteobacteria; Class:  Alphaproteobacteria; Order:  Sphingomonadales; Family:  Sphingomonadaceae
tacggagggagctagcgttgttcggaattactgggcgtaaagcgcacgtaggcggcgactcaagtcaggggtgaaagcccggggctcaaccccggaactgcctttgaaactaggttgctagaatcttggagaggtcagtggaattctgagtgtagaggtgaaattcgtagatattcggaagaacaccagtggcgaaggcggctgactggactggtattgacgctgaggtgcgaaagcgtggggagcaaacagg

SEQ ID NO: 1300 - DNA, 253 bp, Dyadobacter sp.
  OTU_61; Phylum: Bacteroidetes; Class:  Cytophagia; Order:  Cytophagales; Family:  Cytophagaceae
tacggagggtgcgagcgttgtccggatttattgggtttaaagggtgcgtaggtggctaattaagtcagtggtgaaatacagccgcttaacggttgaggtgccattgatactgactagcttgaaagaattggaggctgccggaatggatggtgtagcggtgaaatgcatagatatcatccagaacaccgattgcgaaggcaggtggctacgatttatttgacactgaggcacgaaagcatggggagcaaacagg

SEQ ID NO: 1301 - DNA, 253 bp, Paenisporosarcina sp.
  OTU_217; Phylum: Firmicutes; Class:  Bacilli; Order:  Bacillales; Family:  Planococcaceae
tacgtaggtggcaagcgttgtccggaattattgggcgtaaagcgcgcgcaggcggtcctttaagtctgatgtgaaagcccacggctcaaccgtggagggtcattggaaactgggggacttgagtacagaagaggaaagcggaattccaagtgtagcggtgaaatgcgtagagatttggaggaacaccagtggcgaaggcggctttctggtctgtaactgacgctgaggcgcgaaagcgtggggagcaaacagg

SEQ ID NO: 1302 - DNA, 252 bp, Cohnella sp.
  OTU_3062; Phylum: Firmicutes; Class:  Bacilli; Order:  Bacillales; Family:  Paenibacillaceae
tacgtagggggcaagcgttgtccggaattattgggcgtaaagcgcgcgcaggcggtttcttaagtctggtgtctaagtgcggggctcaaccccgtgatgcactggaaactgggagactcgagtgcagaagaggagagcggaattccacgtgtagcggtgaaatgcgtagagatgtggaggaacaccagtggcgaaggcggctttttggcctgtaactgacgctgaggcgcgaaagcgtggggagcaaacagg

SEQ ID NO: 1303 - DNA, 253 bp, Unknown
  Description of Unknown: Polynucleotide
  OTU_89; Phylum: Firmicutes; Class:  Bacilli; Order:  Bacillales
tacgtaggtggcaagcgttgtccggaattattgggcgtaaagcgcgcgcaggtggtctcttaagtctgatgtgaaagcccccggctcaaccggggagggtcattggaaactgggagacttgagtgcaggagagaagagtggaattccacgtgtagcggtgaaatgcgtagagatgtggaggaacaccagtggcgaaggcgactctttggcctgtaactgacactgaggcgcgaaagcgtggggagcaaacagg

SEQ ID NO: 1304 - DNA, 253 bp, Hymenobacter sp.
  OTU_164; Phylum: Bacteroidetes; Class:  Cytophagia; Order:  Cytophagales; Family:  Cytophagaceae
tacggagggtgcgagcgttgtccggatttattgggtttaaagggtgcgtaggcggcccgttaagtccggggtgaaagcccgctgctcaacagcggaactgccctggatactgacgggcttgagtacagacgaggttggcggaatggactgagtagcggtgaaatgcatagatacagtccagaaccccgattgcgaaggcagctgactaggctgttactgacgctgaggcacgaaagcgtggggagcgaacagg

SEQ ID NO: 1305 - DNA, 253 bp, Chondromyces sp.
  OTU_92; Phylum: Proteobacteria; Class:  Deltaproteobacteria; Order:  Myxococcales; Family:  Polyangiaceae
gacagagggtgcaaacgttgttcggaatgactgggcgtaaagcgcgtgtaggcggctcggcaagtcgggtgtgaaagccctgggctcaacccaggaagtgcactcgaaactgccgagctggagtcccggagaggaaggcggaattctcggtgtagaggtgaaattcgtagatatcgagaggaacaccggtggcgaaggcggccttctggacggcgactgacgctgagacgcgaaagcgtggggagcaaacagg

SEQ ID NO: 1306 - DNA, 253 bp, Methylotenera mobilis
  OTU_115; Phylum: Proteobacteria; Class:  Betaproteobacteria; Order:  Methylophilales; Family:  Methylophilaceae
tacgtagggtgcgagcgttaatcggaattactgggcgtaaagcgtgcgcaggcggtttggcaagtcagatgtgaaatccccgagctcaacttgggaactgcgtttgaaactgccagactagaatatgtcagaggggggtagaattccacgtgtagcagtgaaatgcgtagagatgtggaggaataccaatggcgaaggcagccccctgggataatattgacgctcatgcacgaaagcgtggggagcaaacagg

SEQ ID NO: 1307 - DNA, 253 bp, Devosia sp.
  OTU_28; Phylum: Proteobacteria; Class:  Alphaproteobacteria; Order:  Rhizobiales; Family:  Hyphomicrobiaceae
tacgaagggggctagcgttgttcggatttactgggcgtaaagcgcacgtaggcggatcgttaagtcgggggtgaaatcctggagctcaactccagaactgccttcgatactggcgatcttgagtccggaagaggtgagtggaactcctagtgtagaggtggaattcgtagatattaggaagaacaccagtggcgaaggcggctcactggtccggtactgacgctgaggtgcgaaagcgtggggagcaaacagg

SEQ ID NO: 1308 - DNA, 253 bp, Unknown
  Description of Unknown: Polynucleotide
  OTU_95; Phylum: Bacteroidetes; Class:  Saprospirae; Order:  Saprospirales; Family:  Chitinophagaceae
tacggagggtgcaagcgttatccggattcactgggtttaaagggtgcgtaggcgggtatgtaagtcagtggtgaaatcctcgagcttaactcgagaactgccattgatactatgtatcttgaatgtcatggaggtgagcggaatatgtcatgtagcggtgaaatgcttagatatgacatagaacaccgattgcgaaggcagctcactacacgaatattgacgctgaggcacgaaagcgtggggatcaaacagg

SEQ ID NO: 1309 - DNA, 253 bp, Flavobacterium sp.
  OTU_66; Phylum: Bacteroidetes; Class:  Flavobacteriia; Order:  Flavobacteriales; Family:  Flavobacteriaceae
tacggaggatccaagcgttatccggaatcattgggtttaaagggtccgtaggcggtttaataagtcagtggtgaaagcctatcgcttaacgatagaacggccattgatactgttagacttgaattagtgggaagtaactagaatatgtagtgtagcggtgaaatgcttagatattacatggaataccaattgcgaaggcaggttactatcactatattgacgctgatggacgaaagcgtggggagcgaacagg

SEQ ID NO: 1310 - DNA, 253 bp, Simplicispira sp.
  OTU_356; Phylum: Proteobacteria; Class:  Betaproteobacteria; Order:  Burkholderiales; Family:  Comamonadaceae
tacgtagggtgcaagcgttaatcggaattactgggcgtaaagcgtgcgcaggcggttatataagacagatgtgaaatccccgggctcaacctgggaactgcattagtgactgtatagctagagtgcggcagagggggatggaattccgcgtgtagcagtgaaatgcgtagatatgcggaggaacaccgatggcgaaggcaatcccctgggcctgcactgacgctcatgcacgaaagcgtggggagcaaacagg

SEQ ID NO: 1311 - DNA, 253 bp, Novosphingobium sp.
  OTU_64; Phylum: Proteobacteria; Class:  Alphaproteobacteria; Order:  Sphingomonadales; Family:  Sphingomonadaceae
tacggagggagctagcgttgttcggaattactgggcgtaaagcgcacgtaggcggctactcaagtcagaggtgaaagcccggggctcaaccccggaactgcctttgaaactaggtagctggaatcttggagaggtcagtggaattccgagtgtagaggtgaaattcgtagatattcggaagaacaccagtggcgaaggcgactgactggacaagtattgacgctgaggtgcgaaagcgtggggagcaaacagg

SEQ ID NO: 1312 - DNA, 252 bp, Paenibacillus barengoltzii
  OTU_557; Phylum: Firmicutes; Class:  Bacilli; Order:  Bacillales; Family:  Paenibacillaceae
tacgtagggggcgagcgttgtccggaattattgggcgtaaagcgcgcgcaggcggctgtttaagtctggtgtttaatcctggggctcaaccccgggtcgcactggaaactggacagcttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacagg

SEQ ID NO: 1313 - DNA, 252 bp, Paenibacillus sp.
  OTU_584; Phylum: Firmicutes; Class:  Bacilli; Order:  Bacillales; Family:  Paenibacillaceae
tacgtagggggcaagcgttgtccggaattattgggcgtaaagcgcgcgcaggcggttttttaagtctggggtttaagttcggggctcaaccccgtatcgccctggaaactggggaactggagtgtaggagaggaaagtggaattccacgtgtagcggtgaaatgcgtagagatgtggaggaacaccagtggcgaaggcgactttctggcctataactgacgctgaggcgcgaaagcgtggggagcaaacagg

SEQ ID NO: 1314 - DNA, 253 bp, Microbacterium sp.
  OTU_3738; Phylum: Actinobacteria; Class:  Actinobacteria; Order:  Actinomycetales; Family:  Microbacteriaceae
tacgtagggcgcaagcgttatccggaattattgggcgtaaagagctcgtaggcgatttgtcgcgtctgctgtgaaattccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagggtggggagcaaacagg

SEQ ID NO: 1315 - DNA, 252 bp, Streptococcus sp.
  OTU_1618; Phylum: Firmicutes; Class:  Bacilli; Order:  Lactobacillales; Family:  Streptococcaceae
tacgtaggtcccgagcgttgtccggatttattgggcgtaaagcgagcgcaggcggtttgataagtctgaagttaaaggctgtggctcaaccatagttcgctttggaaactgtcaaacttgagtgcagaaggggagagtggaattccatgtgtagcggtgaaatgcgtagatatatggaggaacaccggtggcgaaagcggctctctggcctgtaactgacactgaggctcgaaagcgtggggagcaaacagg

SEQ ID NO: 1316 - DNA, 253 bp, Haemophilus parainfluenzae
  OTU_1703; Phylum: Proteobacteria; Class:  Gammaproteobacteria; Order:  Pasteurellales; Family:  Pasteurellaceae
tacggagggtgcgagcgttaatcggaataactgggcgtaaagggcacgcaggcggtgacttaagtgaggtgtgaaagccccgggcttaacctgggaattgcatttcatactgggtcgctagagtactttagggaggggtagaattccacgtgtagcggtgaaatgcgtagagatgtggaggaataccgaaggcgaaggcagccccttgggaatgtactgacgctcatgtgcgaaagcgtggggagcaaacagg

SEQ ID NO: 1317 - DNA, 253 bp, Thermoanaerobacterium sp.
  OTU_1137; Phylum: Firmicutes; Class:  Clostridia; Order:  Clostridiales; Family:  Clostridiaceae
tacgtagggggcaagcgttgtccggagtgactgggcgtaaagggcgcgtaggcggttatacaagtcaggtgtaaaagataccggctcaaccggtaggtagcatctgatactgtataactagagtacaggagaggggagcggaattcctggtgtagcggtgaaatgcgtagagatcaggaagaacaccggtggcgaaggcggctctctggcctgggactgacgctgaggcgcgaaagcgtggggagcgaacagg

SEQ ID NO: 1318 - DNA, 253 bp, Methyloversatilis sp.
  OTU_631; Phylum: Proteobacteria; Class:  Betaproteobacteria; Order:  Rhodocyclales; Family:  Rhodocyclaceae
tacgtagggtgcgagcgttaatcggaattactgggcgtaaagcgtgcgcaggcggttgtgtaagacaggtgtgaaatccccgggcttaacctgggaactgcgcttgtgactgcacagctagagtatggcagaggggggtggaattccacgtgtagcagtgaaatgcgtagagatgtggaggaacaccgatggcgaaggcagccccctgggccaatactgacgctcatgcacgaaagcgtggggagcaaacagg

SEQ ID NO: 1319 - DNA, 253 bp, Caloramator sp.
  OTU_881; Phylum: Firmicutes; Class:  Clostridia; Order:  Clostridiales; Family:  Clostridiaceae
tacgtaggtggcaagcgttgtccggaattactgggcgtaaagggtgcgtaggcggtcctttaagtgggatgtgaaatccctgggcttaacccaggaactgcattccaaactggaggactagagtgcaggagaggaaagcggtattcccagtgtagcggtgaaatgcgtagagattgggaggaacaccagtagcgaaggcggctttctggaatgtaactgacgctgaggcacgaaagcgtggggagcaaacagg

SEQ ID NO: 1320 - DNA, 253 bp, Steroidobacter sp.
  OTU_661; Phylum: Proteobacteria; Class:  Gammaproteobacteria; Order:  Xanthomonadales; Family:  Sinobacteraceae
tacagagggtgcgagcgttaatcggaattactgggcgtaaagcgcgcgtaggcggctttgtaagtcggttgtgaaatccccgggcttaacctgggaactgcatccgagactgcatagctagagtatgggagagggaagtggaatttcaggtgtagcggtgaaatgcgtagatatctgaaggaacatcagtggcgaaagcgacttcctggaccaatactgacgctcatgtgcgaaagcgtggggagcaaacagg

SEQ ID NO: 1321 - DNA, 253 bp, Actinomyces sp.
  OTU_3561; Phylum: Actinobacteria; Class:  Actinobacteria; Order:  Actinomycetales; Family:  Actinomycetaceae
tacgtagggcgcgagcgttgtccggaattattgggcgtaaagggcttgtaggcggctggtcgcgtctgccgtgaaattctccggctcaaccgggggcttgcggtgggtacgggccggctggagtgcggtaggggaggctggaactcctggtgtagcggtggaatgcgcagatatcaggaggaacaccggtggcgaaggcgggtctctgggccgttactgacgctgaggagcgaaagcgtggggagcgaacagg

SEQ ID NO: 1322 - DNA, 252 bp, Cohnella sp.
  OTU_22; Phylum: Firmicutes; Class:  Bacilli; Order:  Bacillales; Family:  Paenibacillaceae
tacgtagggggcaagcgttgtccggaattattgggcgtaaagcgcgcgcaggcggttctttaagtctggtgtctaagtgcggggctcaaccccgtgatgcactggaaactggggaacttgagtgcagaagaggagagcggaattccacgtgtagcggtgaaatgcgtagagatgtggaggaacaccagtggcgaaggcggctctctggactgtaactgacgctgaggcgcgaaagcgtggggagcaaacagg

SEQ ID NO: 1323 - DNA, 253 bp, Unknown
  Description of Unknown: Polynucleotide
  OTU_54; Phylum: Bacteroidetes; Class:  Sphingobacteriia; Order:  Sphingobacteriales
gacgaaggatgcaagcgttatccggattcattgggtttaaagggtgcgtaggcggacctgtaagtcagtggtgaaatctctcagcttaactgagaaactgccattgatactgcaggtctagagtatagatgacgttggcggaatatgacatgtagtggtgaaatacttagatatgtcatagaacaccgattgcgaaggcagctaacgaaactataactgacgctgaggcacgaaagtgcggggatcaaacagg

SEQ ID NO: 1324 - DNA, 253 bp, Unknown
  Description of Unknown: Polynucleotide
  OTU_240; Phylum: Bacteroidetes; Class:  Saprospirae; Order:  Saprospirales; Family:  Chitinophagaceae
tacggagggtgcaagcgttatccggattcactgggtttaaagggtgcgtaggcgggcatttaagtcagtggtgaaatacctgagcttaacttgggaactgccattgatactatttgtcttgaatgtcgtggaggttagcggaatatgtcatgtagcggtgaaatgcttagatatgacatagaacacctattgcgaaggcagctaactacgcgaatattgacgctgaggcacgaaagcgtggggatcaaacagg

SEQ ID NO: 1325 - DNA, 253 bp, Sphingomonas sp.
  OTU_3194; Phylum: Proteobacteria; Class:  Alphaproteobacteria; Order:  Sphingomonadales; Family:  Sphingomonadaceae
tacggagggagctagcgttgttcggaattactgggcgtaaagcacacgtaggcggctttgtaagttagaggtgaaagcctggagctcaactccagaattgcctttaagactgcatcgcttgaatccaggagaggtgagtggaattccgagtgtagaggtgaaattcgtagatattcggaagaacaccagtggcgaaggcggctcactggactggtattgatgctgaggtgcgaaagcgtggggagcgaacagg

SEQ ID NO: 1326 - DNA, 253 bp, Unknown
  Description of Unknown: Polynucleotide
  OTU_139; Phylum: Firmicutes; Class:  Bacilli; Order:  Bacillales
tacgtaggtggcaagcgttatccggaattattgggcgtaaagcgcgcgcaggcggtctcttaagtctgatgtgaaagcccacggctcaaccgtggagggtcattggaaactgggagacttgagtgcaggagagaaaagtggaattccacgtgtagcggtgaaatgcgtagagatgtggaggaacaccagtggcgaaggcggctttttggcctgtaactgacgctgaggcgcgaaagcgtggggagcaaacagg

SEQ ID NO: 1327 - DNA, 253 bp, Stenotrophomonas sp.
  OTU_10; Phylum: Proteobacteria; Class:  Gammaproteobacteria; Order:  Xanthomonadales; Family:  Xanthomonadaceae
tacgaagggtgcaagcgttactcggaattactgggcgtaaagcgtgcgtaggtggttgtttaagtctgttgtgaaagccctgggctcaacctgggaactgcagtggaaactggacaactagagtgtggtagagggtagcggaattcccggtgtagcagtgaaatgcgtagagatcgggaggaacatccatggcgaaggcagctacctggaccaacactgacactgaggcacgaaagcgtggggagcaaacagg

SEQ ID NO: 1328 - DNA, 253 bp, Mycoplana sp.
  OTU_176; Phylum: Proteobacteria; Class:  Alphaproteobacteria; Order:  Caulobacterales; Family:  Caulobacteraceae
tacgaagggggctagcgttgctcggaattactgggcgtaaagggagcgtaggcggacatttaagtcaggggtgaaatcccagagctcaactctggaactgcctttgatactggatgtcttgagtgtgagagaggtaagtggaactccgagtgtagaggtgaaattcgtagatattcggaagaacaccagtggcgaaggcgacttactggctcattactgacgctgaggctcgaaagcgtggggagcaaacagg

SEQ ID NO: 1329 - DNA, 252 bp, Unknown
  Description of Unknown: Polynucleotide
  OTU_101; Phylum: Firmicutes; Class:  Bacilli; Order:  Bacillales; Family:  Paenibacillaceae
tacgtagggggcaagcgttgtccggaattattgggcgtaaagcgcgcgcaggcggtcctttaagtcttgtgtttaatcccagagctcaactttggtacgcatgggaaactggaggactggagtgcaggagaggaaagtggaattccacgtgtagcggtgaaatgcgtagagatgtggaggaacaccagtggcgaaggcgactttctggcctgtaactgacgctgaggcgcgaaagcgtggggagcaaacagg

SEQ ID NO: 1330 - DNA, 253 bp, Unknown
  Description of Unknown: Polynucleotide
  OTU_604; Phylum: Proteobacteria; Class:  Alphaproteobacteria; Order:  Sphingomonadales; Family:  Erythrobacteraceae
tacggagggagctagcgttgttcggaattactgggcgtaaagcgcacgtaggcggcgatccaagtcagaggtgaaatcccggggctcaaccccggaactgcctttgaaactagattgctagaatcctggagaggtgagtggaattccgagtgtagaggtgaaattcgtagatattcggaagaacaccagtggcgaaggcgactcactggacaggtattgacgctgaggtgcgaaagcgtggggagcaaacagg

SEQ ID NO: 1331 - DNA, 253 bp, Unknown
  Description of Unknown: Polynucleotide
  OTU_588; Phylum: Firmicutes; Class:  Bacilli; Order:  Bacillales
tacgtaggtggcaagcgttgtccggaattattgggcgtaaagagcgcgcaggcggtcttttaagtctgatgtgaaagcccctggctcaaccggggagggtcattggaaactgggagacttgagtgcagaagagaagagcggaattccacgtgtagcggtgaaatgcgtagagatgtggaggaacaccagtggcgaaggcggctctttggtctgtaactgacgctgaggcgcgaaagcgtggggagcaaacagg

SEQ ID NO: 1332 - DNA, 253 bp, Pseudomonas sp.
  OTU_3676; Phylum: Proteobacteria; Class:  Gammaproteobacteria; Order:  Pseudomonadales; Family:  Pseudomonadaceae
tacagagggtgcaggcgttaatcggaattactgggcgtaaagcgcgcgtaggtggttcgttaagttggatgtgaaatccccgggctcaacccgggaactgcattcaaaactgacgagctagagtatggtagagggtggtggaatttcctgtgtagcggtgaaatgtgtagatataggaaggaacaccagtggcgaaggcgaccacctggactgatactgacgctgaggtgcgaaagcgtggggagcaaacagg

SEQ ID NO: 1333 - DNA, 253 bp, Mycoplana sp.
  OTU_183; Phylum: Proteobacteria; Class:  Alphaproteobacteria; Order:  Caulobacterales; Family:  Caulobacteraceae
tacgaagggggctagcgttgctcggaattactgggcgtaaagggcgcgtaggcggacatttaagtcaggggtgaaatcccgaggctcaacctcggaattgcctttgatactgggtgtcttgagtgtgagagaggtatgtggaactccgagtgtagaggtgaaattcgtagatattcggaagaacaccagtggcgaaggcgacatactggctcattactgacgctgaggcgcgaaagcgtggggagcaaacagg

SEQ ID NO: 1334 - DNA, 253 bp, Devosia sp.
  OTU_2966; Phylum: Proteobacteria; Class:  Alphaproteobacteria; Order:  Rhizobiales; Family:  Hyphomicrobiaceae
tacgaagggggctagcgttgttcggatttactgggcgtaaagcgcacgtaggcggtttgttaagtcagaggtgaaatcccggagctcaactccggaactgcctttgatactggcaagctagagtccggaagaggtaagtggaactcctagcgtagaggtggaattcgtagatattaggaagaacaccagtggcgaaggcggcttactggtccggaactgacgctcatgcacgaaagcgtggggagcaaacagg

SEQ ID NO: 1335 - DNA, 253 bp, Bradyrhizobium sp.
  OTU_71; Phylum: Proteobacteria; Class:  Alphaproteobacteria; Order:  Rhizobiales; Family:  Bradyrhizobiaceae
tacgaagggggctagcgttgctcggaatcactgggcgtaaagggtgcgtaggcgggtctttaagtcaggggtgaaatcctggagctcaactccagaactgcctttgatactgaggatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacagg

SEQ ID NO: 1336 - DNA, 253 bp, Dyadobacter sp.
  OTU_343; Phylum: Bacteroidetes; Class:  Cytophagia; Order:  Cytophagales; Family:  Cytophagaceae
tacggagggtgcgagcgttgtccggatttattgggtttaaagggtgcgtaggtggcctagtaagtcagtggtgaaatacggttgctcaacaatcgaggtgccattgatactgcaaggcttgaaataattggaggctgccggaatggatggtgtagcggtgaaatgcatagatatcatccagaacaccgattgcgaaggcaggtggctacgatttgtttgacactgaggcacgaaagcatggggagcaaacagg

SEQ ID NO: 1337 - DNA, 253 bp, Unknown
  Description of Unknown: Polynucleotide
  OTU_99; Phylum: Bacteroidetes; Class:  Saprospirae; Order:  Saprospirales; Family:  Chitinophagaceae
tacggagggtgcaagcgttatccggatttactgggtttaaagggtgcgtaggtgggctgataagtcagtggtgaaatcttcgagcttaactcggaaactgccgttgatactattagtcttgaattttctggaggtaagcggaatatgtcatgtagcggtgaaatgcttagatatgacatagaacaccaattgcgaaggcagcttgctacaggaacattgacactgaggcacgaaagcgtggggatcaaacagg

SEQ ID NO: 1338 - DNA, 252 bp, Paenibacillus sp.
  OTU_104; Phylum: Firmicutes; Class:  Bacilli; Order:  Bacillales; Family:  Paenibacillaceae
tacgtagggggcaagcgttgtccggaattattgggcgtaaagcgcgcgcaggcggccgcttaagtttggtgtataagcccggggctcaaccccggatcgcaccgaaaactgggtggcttgagtgcaggagaggaaagcggaattccacgtgtagcggtgaaatgcgtagagatgtggaggaacaccagtggcgaaggcggctttctggactgtaactgacgctgaggcgcgaaagcgtggggagcaaacagg

SEQ ID NO: 1339 - DNA, 253 bp, Achromobacter sp.
  OTU_3760; Phylum: Proteobacteria; Class:  Betaproteobacteria; Order:  Burkholderiales; Family:  Alcaligenaceae
tacgtagggtgcaagcgttaatcggaattactgggcgtaaagcgtgcgcaggcggttcggaaagaaagatgtgaaatcccagagcttaactttggaactgcattttcaactcccgagctagagtgtgtcagagggaggtggaattccgcgtgtagcagtgaaatgcgtagatatgcggaggagcaccgatggcgaaggcagcctcctgggataacactgacgctcatgcacgaaagcgtggggagcaaacagg

SEQ ID NO: 1340 - DNA, 253 bp, Bacillus firmus; identical to SEQ ID NO: 1100
  OTU_13; Phylum: Firmicutes; Class:  Bacilli; Order:  Bacillales; Family:  Bacillaceae

SEQ ID NO: 1341 - DNA, 253 bp, Agrobacterium sp.
  OTU_51; Phylum: Proteobacteria; Class:  Alphaproteobacteria; Order:  Rhizobiales; Family:  Rhizobiaceae
tacgaagggggctagcgttgttcggaattactgggcgtaaagcgcacgtaggcggacatttaagtcaggggtgaaatcccggggctcaacctcggaactgcctttgatactgggtgtctagagtatggaagaggtaagtggaattgcgagtgtagaggtgaaattcgtagatattcgcaggaacaccagtggcgaaggcggcttactggtccattactgacgctgaggtgcgaaagcgtggggagcaaacagg

SEQ ID NO: 1342 - DNA, 253 bp, Caulobacter sp.
  OTU_86; Phylum: Proteobacteria; Class:  Alphaproteobacteria; Order:  Caulobacterales; Family:  Caulobacteraceae
tacgaagggggctagcgttgctcggaattactgggcgtaaagggagcgtaggcggactgtttagtcagaggtgaaagcccagggctcaaccttggaattgcctttgatactggcagtcttgagtacggaagaggtatgtggaactccgagtgtagaggtgaaattcgtagatattcggaagaacaccagtggcgaaggcgacatactggtccgttactgacgctgaggctcgaaagcgtggggagcaaacagg

SEQ ID NO: 1343 - DNA, 253 bp, Flavobacterium sp.
  OTU_130; Phylum: Bacteroidetes; Class:  Flavobacteriia; Order:  Flavobacteriales; Family:  Flavobacteriaceae
tacggaggatccaagcgttatccggaatcattgggtttaaagggtccgtaggcggccctgtaagtcagtggtgaaatctcacggctcaaccgtgaaattgccattgatactgcagggcttgaattatcgggaagcaactagaatatgtagtgtagcggtgaaatgcttagatattacatggaataccgattgcgaaggcaggttgctaccggtggattgacgctgatggacgaaagcgtggggagcgaacagg

SEQ ID NO: 1344 - DNA, 253 bp, Xanthomonas sp.
  OTU_73; Phylum: Proteobacteria; Class:  Gammaproteobacteria; Order:  Xanthomonadales; Family:  Xanthomonadaceae
tacgaagggtgcaagcgttactcggaattactgggcgtaaagcgtgcgtaggtggttgtttaagtccgttgtgaaagccctgggctcaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaaacagg

SEQ ID NO: 1345 - DNA, 253 bp, Flavobacterium sp.
  OTU_53; Phylum: Bacteroidetes; Class:  Flavobacteriia; Order:  Flavobacteriales; Family:  Flavobacteriaceae
tacggaggatccaagcgttatccggaatcattgggtttaaagggtccgtaggcggctttataagtcagtggtgaaagcccatcgcttaacgatggaacggccattgatactgtagagcttgaattacttggaagtaactagaatatgtagtgtagcggtgaaatgcttagatattacatggaataccaattgcgaaggcaggttactacaagtggattgacgctgatggacgaaagcgtggggagcgaacagg

SEQ ID NO: 1346 - DNA, 252 bp, Paenibacillus sp.
  OTU_15; Phylum: Firmicutes; Class:  Bacilli; Order:  Bacillales; Family:  Paenibacillaceae
tacgtagggggcaagcgttgtccggaattattgggcgtaaagcgcgcgcaggcggtcatgtaagtctggtgtttaatcccggggctcaaccccggatcgcactggaaactgcgtgacttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacagg

SEQ ID NO: 1347 - DNA, 252 bp, Brevibacillus invocatus
  OTU_3272; Phylum: Firmicutes; Class:  Bacilli; Order:  Bacillales; Family:  Paenibacillaceae
tacgtaggtggcaagcgttgtccggatttattgggcgtaaagcgcgcgcaggcggctatgtaagtctggtgttaaagcccggggctcaaccccggttcgcatcggaaactgtgtagcttgagtgcagaagaggaaagcggtattccacgtgtagcggtgaaatgcgtagagatgtggaggaacaccagtggcgaaggcggctttctggtctgtaactgacgaggagaagagaaagcggggggagcaaacagg

SEQ ID NO: 1348 - DNA, 252 bp, Brevibacillus sp.
  OTU_33; Phylum: Firmicutes; Class:  Bacilli; Order:  Bacillales; Family:  Paenibacillaceae
tacgtaggtggcaagcgttgtccggaattattgggcgtaaagcgcgcgcaggcggctatgtaagtctggtgttaaagcccggggctcaaccccggttcgcatcggaaactgcgtagcttgagtgcagaagaggaaagcggtattccacgtgtagcggtgaaatgcgtagagatgtggaggaacaccagtggcgaaggcggctttctggtctgtaactgacgctgaggcgcgaaagcgtggggagcaaacagg

SEQ ID NO: 1349 - DNA, 253 bp, Unknown
  Description of Unknown: Polynucleotide
  OTU_148; Phylum: Proteobacteria; Class:  Betaproteobacteria; Order:  Burkholderiales; Family:  Comamonadaceae
tacgtagggtgcaagcgttaatcggaattactgggcgtaaagcgtgcgcaggcggtcttgtaagacagaggtgaaatccccgggctcaacctgggaactgcctttgtgactgcaaggctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacagg

SEQ ID NO: 1350 - DNA, 252 bp, Paenibacillus sp.
  OTU_779; Phylum: Firmicutes; Class:  Bacilli; Order:  Bacillales; Family:  Paenibacillaceae
tacgtagggggcaagcgttgtccggaattattgggcgtaaagcgcgcgcaggcggcgatgtaagtctggtgtttaaaccttgggctcaacctggggtcgcacgggaaactggatcgcttgagtacagaagaggaaagtggaattccacgtgtagcggtgaaatgcgtagagatgtggaggaacaccagtggcgaaggcgactttctgggctgtaactgacgctgaggcgcgaaagcgtggggagcaaacagg

SEQ ID NO: 1351 - DNA, 253 bp, Arthrobacter psychrolactophilus; identical to SEQ ID NO: 1037
  OTU_123; Phylum: Actinobacteria; Class:  Actinobacteria; Order:  Actinomycetales; Family:  Micrococcaceae

SEQ ID NO: 1352 - DNA, 253 bp, Pseudomonas sp.
  OTU_4; Phylum: Proteobacteria; Class:  Gammaproteobacteria; Order:  Pseudomonadales; Family:  Pseudomonadaceae
tacgaagggtgcaagcgttaatcggaattactgggcgtaaagcgcgcgtaggtggcttgataagttggatgtgaaatccccgggctcaacctgggaactgcatccaaaactgtctggctagagtgtggtagagggtagtggaatttccagtgtagcggtgaaatgcgtagatattggaaggaacaccagtggcgaaggcgactacctggactaacactgacactgaggtgcgaaagcgtggggagcaaacagg

SEQ ID NO: 1353 - DNA, 253 bp, Agrobacterium sp.
  OTU_204; Phylum: Proteobacteria; Class:  Alphaproteobacteria; Order:  Rhizobiales; Family:  Rhizobiaceae
tacgaagggggctagcgttgttcggaattactgggcgtaaagcgcacgtaggcggacatttaagtcaggggtgaaatcccagagctcaactctggaactgcctttgatactgggtgtcttgagtgtggaagaggtcagtggaattgcgagtgtagaggtgaaattcgtagatattcgcaggaacaccagtggcgaaggcggctgactggtccacaactgacgctgaggtgcgaaagcgtggggagcaaacagg

SEQ ID NO: 1354 - DNA, 252 bp, Paenibacillus sp.
  OTU_264; Phylum: Firmicutes; Class:  Bacilli; Order:  Bacillales; Family:  Paenibacillaceae
tacgtagggggcaagcgttgtccggaattattgggcgtaaagcgcgcgcaggcggctgattaagttcggtgtttaatcctggggctcaaccctaggtcgcactggaaactggttggcttgagtgcagaagaggaaagtggaattccacgtgtagcggtgaaatgcgtagagatgtggaggaacaccagtggcgaaggcgactttctgggctgtaactgacgctgaggcgcgaaagcgtggggagcaaacagg

SEQ ID NO: 1355 - DNA, 253 bp, Unknown
  Description of Unknown: Polynucleotide
  OTU_1004; Phylum: Proteobacteria; Class:  Alphaproteobacteria; Order:  Ellin329
tacgaagggggctagcgttgttcggaattactgggcgtaaagcgcgcgcaggcggtcctttaagtcaggggtgaaagcccagagctcaactctggaactgcctttgaaactagaggacttgggtacgggagaggtgagtggaattccgagtgtagaggtgaaattcgtagatattcggaagaacaccagtggcgaaggcggctcactggcccgttaccgacgctcaggcgcgacagcgtggggagcaaacagg

SEQ ID NO: 1356 - DNA, 253 bp, Novosphingobium sp.
  OTU_3042; Phylum: Proteobacteria; Class:  Alphaproteobacteria; Order:  Sphingomonadales; Family:  Sphingomonadaceae
tacgtaggatgcaagcgttgttcggaattactgggcgtaaagcgtacgtaggcggttactcaagtcagaggtgaaagcccggggctcaaccccggaactgcctttgaaactaggtagctagaatcttggagaggtcagtggaattccgagtgtagaggtgaaattcgtagatattcggaagaacaccagtggcgaaggcgactgactggacaagtattgacgctgaggtacgaaagcgtggggagcaaacagg

SEQ ID NO: 1357 - DNA, 253 bp, Unknown
  Description of Unknown: Polynucleotide
  OTU_77; Phylum: Proteobacteria; Class:  Betaproteobacteria; Order:  Burkholderiales; Family:  Comamonadaceae
tacgtagggtgcgagcgttaatcggaattactgggcgtaaagcgtgcgcaggcggctttgcaagacagatgtgaaatccccgggctcaacctgggaactgcatttgtgactgcaaggctagagtacggcagagggggatggaattccgcgtgtagcagtgaaatgcgtagatatgcggaggaacaccgatggcgaaggcaatcccctgggcctgtactgacgctcatgcacgaaagcgtggggagcaaacagg

SEQ ID NO: 1358 - DNA, 252 bp, Paenibacillus sp.
  OTU_60; Phylum: Firmicutes; Class:  Bacilli; Order:  Bacillales; Family:  Paenibacillaceae
tacgtagggggcaagcgttgtccggaattattgggcgtaaagcgcgcgcaggcggctctttaagtctggtgtttaatcccgaggctcaacttcgggtcgcactggaaactggggagcttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacagg

SEQ ID NO: 1359 - DNA, 253 bp, Rhodanobacter sp.
  OTU_3678; Phylum: Proteobacteria; Class:  Gammaproteobacteria; Order:  Xanthomonadales; Family:  Xanthomonadaceae
tacggagggtgcgagcgttgttcggaattactgggcgtaaagggtgcgtaggcggttgtttaagtctgtcgtgaaatccccgggctcaacctgggaatggcgatggatactgggcagctagagtgtgtcagaggatggtggaattcccggtgtagcggtgaaatgcgtagagatcgggaggaacatcagtggcgaaggcggccatctgggacaacactgacgctgaagcacgaaagcgtggggagcaaacagg

SEQ ID NO: 1360 - DNA, 252 bp, Paenibacillus sp.
  OTU_67; Phylum: Firmicutes; Class:  Bacilli; Order:  Bacillales; Family:  Paenibacillaceae
tacgtagggggcaagcgttgtccggaattattgggcgtaaagcgcgcgcaggcggttcagtaagttggatgtttaaagccggggctcaaccccggtgcgcatccaaaactggtggacttgagtgtaggagaggaaagtggaattccacgtgtagcggtgaaatgcgtagagatgtggaggaacaccagtggcgaaggcgactttctggcctataactgacgctgaggcgcgaaagcgtggggagcaaacagg

SEQ ID NO: 1361 - DNA, 252 bp, Cohnella sp.
  OTU_2406; Phylum: Firmicutes; Class:  Bacilli; Order:  Bacillales; Family:  Paenibacillaceae
tacgtagggggcaagcgttgtccggaattattgggcgtaaagcgcgcgcaggcggtcttttaagtctggtgtttaggtgcggggctcaaccccgtgacgcactggaaactgggagactcgagtgcagaagaggagggcggaattccacgtgtagcggtgaaatgcgtagagatgcggaggaacaccagtggcgaaggcggctctctggactgtaactgacgctgaggcgcgaaagcgtggggagcaaacagg

SEQ ID NO: 1362 - DNA, 252 bp, Paenibacillus sp.
  OTU_134; Phylum: Firmicutes; Class:  Bacilli; Order:  Bacillales; Family:  Paenibacillaceae
tacgtagggggcaagcgttgtccggaattattgggcgtaaagcgcgcgcaggcggttttttaagtctggggtttaattgcagggctcaaccctgtatcgcctcggaaactgggagactggagtgtaggagagggaagtggaattccacgtgtagcggtgaaatgcgtagagatgtggaggaacaccagtggcgaaggcgacttcctggcctataactgacgctgaggcgcgaaagcgtggggagcaaacagg

SEQ ID NO: 1363 - DNA, 253 bp, Sphingomonas yabuuchiae; identical to SEQ ID NO: 1132
  OTU_50; Phylum: Proteobacteria; Class:  Alphaproteobacteria; Order:  Sphingomonadales; Family:  Sphingomonadaceae

SEQ ID NO: 1364 - DNA, 253 bp, Acinetobacter johnsonii
  OTU_90; Phylum: Proteobacteria; Class:  Gammaproteobacteria; Order:  Pseudomonadales; Family:  Moraxellaceae
tacagagggtgcgagcgttaatcggatttactgggcgtaaagcgtgcgtaggcggctttttaagtcggatgtgaaatccctgagcttaacttaggaattgcattcgatactgggaagctagagtatgggagaggatggtagaattccaggtgtagcggtgaaatgcgtagagatctggaggaataccgatggcgaaggcagccatctggcctaatactgacgctgaggtacgaaagcatggggagcaaacagg

SEQ ID NO: 1365 - DNA, 253 bp, Salinibacterium sp.
  OTU_188; Phylum: Actinobacteria; Class:  Actinobacteria; Order:  Actinomycetales; Family:  Microbacteriaceae
tacgtagggtgcaagcgttatccggaattattgggcgtaaagagctcgtaggcggtttgtcgcgtctgctgtgaaaacccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcatggggagcgaacagg

SEQ ID NO: 1366 - DNA, 253 bp, Deinococcus sp.
  OTU_52; Phylum: Thermi; Class:  Deinococci; Order:  Deinococcales; Family:  Deinococcaceae
tacggagggtgcaagcgttacccggaatcactgggcgtaaagggcgtgtaggcggttatttaagtctggttttaaagaccggggctcaaccccgggagtggactggatactggatgacttgacctctggagagggaactggaattcctggtgtagcggtggaatgcgtagataccaggaggaacaccaatggcgaaggcaagttcctggacagaaggtgacgctgaggcgcgaaagtgtggggagcgaaccgg

SEQ ID NO: 1367 - DNA, 253 bp, Sphingomonas sp.
  OTU_141; Phylum: Proteobacteria; Class:  Alphaproteobacteria; Order:  Sphingomonadales; Family:  Sphingomonadaceae
tacgaggggagctagcgttattcggaattactgggcgtaaagcgcacgtaggcggctttgtaagtaagaggtgaaagcctggagctcaactccagaactgccttttagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacagg

SEQ ID NO: 1368 - DNA, 253 bp, Azospirillum sp.
  OTU_124; Phylum: Proteobacteria; Class:  Alphaproteobacteria; Order:  Rhodospirillales; Family:  Rhodospirillaceae
tacgaagggggctagcgttgttcggaattactgggcgtaaagggcgcgtaggcggcctgtttagtcagaagtgaaagccccgggctcaacctgggaatagcttttgatactggcaggcttgagttccggagaggatggtggaattcccagtgtagaggtgaaattcgtagatattgggaagaacaccggtggcgaaggcggccatctggacggacactgacgctgaggcgcgaaagcgtggggagcaaacagg

SEQ ID NO: 1369 - DNA, 252 bp, Paenibacillus sp.
  OTU_34; Phylum: Firmicutes; Class:  Bacilli; Order:  Bacillales; Family:  Paenibacillaceae
tacgtagggggcaagcgttgtccggaattattgggcgtaaagcgcgcgcaggcggctaattaagtctggtgtttaaggctggggctcaaccccggttcgcactggaaactggttggcttgagtgcagaagaggaaagtggaattccacgtgtagcggtgaaatgcgtagagatgtggaggaacaccagtggcgaaggcgactttctgggctgtaactgacgctgaggcgcgaaagcgtggggagcaaacagg

SEQ ID NO: 1370 - DNA, 253 bp, Unknown
  Description of Unknown: Polynucleotide
  OTU_367; Phylum: Proteobacteria; Class:  Alphaproteobacteria; Order:  Sphingomonadales; Family:  Erythrobacteraceae
tacggagggagctagcgttgttcggatatactgggcgtaaagcgcacgtaggcggcgccgtaagtcaggggtgaaatcccggagctcaactccggaactgcctttgaaactgcggtgctagaatcctggagaggcgagtggaattccgagtgtagaggtgaaattcgtagatattcggaagaacaccagtggcgaaggcgactcgctggacaggtattgacgctgaggtgcgaaagcgtggggagcaaacagg

SEQ ID NO: 1371 - DNA, 252 bp, Paenibacillus sp.
  OTU_98; Phylum: Firmicutes; Class:  Bacilli; Order:  Bacillales; Family:  Paenibacillaceae
tacgtagggggcaagcgttgtccggaattattgggcgtaaagcgcgcgcaggcggtttattaagttaggtgtttaatcccggggctcaaccccggttcgcatctgaaactggtgaacttgagtgtaggagaggaaagtggaattccacgtgtagcggtgaaatgcgtagagatgtggaggaacaccagtggcgaaggcgactttctggcctataactgacgctgaggcgcgaaagcgtggggagcaaacagg

SEQ ID NO: 1372 - DNA, 252 bp, Paenibacillus sp.
  OTU_138; Phylum: Firmicutes; Class:  Bacilli; Order:  Bacillales; Family:  Paenibacillaceae
tacgtagggggcaagcgttgtccggaattattgggcgtaaagcgcgcgcaggcggcttggaaagtcgggtgtttaagctcggggctcaaccccgatacgcacccgaaactgccaggcttgagtgcagaagaggaaagtggaattccacgtgtagcggtgaaatgcgtagagatgtggaggaacaccagtggcgaaggcgactttctgggctgtaactgacgctgaggcgcgaaagcgtggggagcaaacagg

SEQ ID NO: 1373 - DNA, 253 bp, Paenibacillus sp.
  OTU_121; Phylum: Firmicutes; Class:  Bacilli; Order:  Bacillales; Family:  Paenibacillaceae
tacgtagggggcaagcgttgtccggaattattgggcgtaaagcgcgcgcaggcggctttgtaagtcttgtgtttaagttcggggctcaaccccgcaaacgcatgggaaactgcaaggcttgagtgcagcagaggaaagcggaattccacgtgtagcggtgaaatgcgtagagatgtggaggaacaccagtggcgaaggcggctttctgggctgtaactgacgctgaggcgcgaaagcgtggggagcaaacagg

SEQ ID NO: 1374 - DNA, 253 bp, Unknown; identical to SEQ ID NO: 1181
  Description of Unknown: Polynucleotide
  OTU_2408; Phylum: Proteobacteria; Class:  Gammaproteobacteria; Order:  Enterobacteriales; Family:  Enterobacteriaceae

SEQ ID NO: 1375 - DNA, 252 bp, Paenibacillus sp.
  OTU_35; Phylum: Firmicutes; Class:  Bacilli; Order:  Bacillales; Family:  Paenibacillaceae
tacgtagggggcaagcgttgtccggaattattgggcgtaaagcgcgcgcaggcggtcatttaagtctggtgtttaaaccttgggctcaacctggggtcgcactggaaactgggtgacttgagtacagaagaggaaagtggaattccacgtgtagcggtgaaatgcgtagatatgtggaggaacaccagtggcgaaggcgactttctgggctgtaactgacgctgaggcgcgaaagcgtggggagcaaacagg

SEQ ID NO: 1376 - DNA, 253 bp, Sphingomonas sp.; identical to SEQ ID NO: 1135
  OTU_62; Phylum: Proteobacteria; Class:  Alphaproteobacteria; Order:  Sphingomonadales; Family:  Sphingomonadaceae

SEQ ID NO: 1377 - DNA, 20 bp, Unknown
  Description of Unknown: Oligonucleotide
aaacctcgtacctcgccagc

The invention claimed is:

1. A method for generating an agricultural seed internally colonized with a bacterial endophyte, the method comprising:

contacting at least one flower of a plurality of agricultural plants with a synthetic formulation comprising a purified bacterial population, the bacterial population comprising a bacterial endophyte in an amount effective to internally colonize at least one seed made by the flower, wherein the bacterial endophyte exhibits the ability to produce cellulase activity and pectinase activity, wherein the contacting results in a concentration of at least 10 CFU of the bacterial endophyte inside the tissue of the at least one internally colonized seed; and the bacterial endophyte is of the genus *Enterobacter* and comprises a 16S nucleic acid sequence comprising SEQ ID NO:905.

2. The method of claim 1, wherein the synthetic formulation further comprises a stabilizer, a fungicide, a preservative, a carrier, a surfactant, or a combination thereof.

3. The method of claim 1, wherein the at least one internally colonized seed is shelf stable at 25 degrees C. for at least 7 days.

4. The method of claim 1, wherein the contacting comprises spraying, immersing, or dusting the at least one flower with the synthetic formulation.

5. The method of claim 1, wherein the purified bacterial population comprises a plurality of bacterial endophyte entities.

6. The method of claim 1, wherein the purified bacterial population comprises a plurality of taxonomically diverse bacterial endophyte entities.

7. The method of claim 1, wherein the at least one flower is a male flower.

8. The method of claim 1, wherein the at least one flower is a female flower.

9. The method of claim 1, further comprising packaging the at least one internally colonized seed in a container.

10. The method of claim 1, wherein the at least one internally colonized seed is shelf-stable at 25 degrees C. for at least 6 months.

11. The method of claim 1, wherein the agricultural plant is a wheat plant.

12. The method of claim 1, wherein the agricultural plant is a barley plant.

* * * * *